United States Patent 7,745,391 (HUMAN THROMBOSPONDIN POLYPEPTIDE) - sequence listing, part 31

SEQ ID NO: 71449 - DNA, 5365 bp, Homo sapiens
ggggaagcttcgcaggcgtgcacggagcagtgagatcactggcgttataaatatcccggtgccagcgcggagatccgctcgggtggcctctctcttcccctctccccttctcttccccgaggctatgtccacccggtgcggcgaggcgggcagagccagaggcacgcagccgcacaggggctacagagcccagaatcagccctacaagatgcacttaggacccccgcggctggaagaatgagcttgtccttcctcctcctcctcttcttcagccacctgatcctcagcgcctgggctcacggggagaagcgtctcgcccccaaagggcaacccggacccgctgccactgataggaaccctagaggctccagcagcagacagagcagcagtagcgctatgtcttcctcttctgcctcctcctcccccgcagcttctctgggcagccaaggaagtggcttggagcagagcagtttccagtggagcccctcggggcgccggaccggcagcctctactgcagagtgggcatcggtttccatctgcagatctacccggatggcaaagtcaatggatcccacgaagccaatatgttaagtgttttggaaatatttgctgtgtctcaggggattgtaggaatacgaggagttttcagcaacaaatttttagcgatgtcaaaaaaaggaaaactccatgcaagtgccaagttcacagatgactgcaagttcagggagcgttttcaagaaaatagctataatacctatgcctcagcaatacatagaactgaaaaaacagggcgggagtggtatgtggccctgaataaaagaggaaaagccaaacgagggtgcagcccccgggttaaaccccagcatatctctacccattttctgccaagattcaagcagtcggagcagccagaactttctttcacggttactgttcctgaaaagaaaaagccacctagccctatcaagccaaagattcccctttctgcacctcggaaaaataccaactcagtgaaatacagactcaagtttcgctttggataatattcctcttggccttgtgagaaaccattctttcccctcaggagtttctataggtgtcttcagagttctgaagaaaaattactggacacagcttcagctatacttacactgtattgaagtcacgtcatttgtttcaatgtgactgaaacaaaatgttttttgataggaaggaaactggaattctttgtactaatacagggagcacactccttcagttcagcaagacataaagccttttgctttatgcttgagggatatttagaactttgtattttcggaaagttaaataacagggactacgtatttttctgacttttacagattaacctgaaagaacatacatgatacatttttatttttggtttccaaagaatattttgatgcagataaaatattttgttaacttttgtttttttttgtttgttttcttaaaagtacctctgcattgagcatattttcttacttttattattttaattaatatgacataagcaatcattttatgctgtttatgaattataaatgtgtttatagctcatttgtaatatggaaatcttttacatttttcctattcactgcacttttttattgtttttatttctagccatacctcagataatatgtttagttttacattttaaaatgtttaaattctctttcacagcaccaaaggctcagcttggatttgtgtgtatgtgtatgtcaattcatgacattatgtggaatcctaaacctttggtggctgggatatgatgggttagaagcaaggagaaaatataaggactttttgatggaattaaatgtgggaggtaaggaaaaggatttagaggtaaaagtacactaagtttgcaacatttattgagatctaagtctgtcttgccttcatttctctttttatctcccccttgccctcattcttgaacagctggaggaatacattttattctgtccatgaagcatacactatgaaattcaagtgcttaaaaatacttctatgactctctgctatcccactgtatagatccacagggagcaaacacttagaaatgatagagaactgaaggagatcaatggtttaacagttatccatgccaagtcccattgtcagaaatattcttattactcagtcaaacactctttgagcttcccttcctaaaggtaaccattccagtgaatagatgtgcccttttataaggaaacttctgatgtttattaaaaaaactggccttttgatagaggtaacttaatttgggaatttgttgtgttgaaatggcatttaatttcaacctaaatactgactgctggacataaatcacagaaaatttaacttaagaaaatttacaaaatttattctcaggtaatcattttaataaagttctgcaaaatacacgtttatcttacattcagaaatgtggcaaaaaaggcatagctaaaggctaaacatatggctttagtagtaacaaaagggttcatagaaacttcatggtttgcatttaaacatgtttaaagtgtacttataaactatttttttcttaaagcaaactatgatttattttggtgcacaaatacaaagtggaaacttaccaaaattgaactagctaccatataagcagattgctttaatttgatgggaaaatagtacacacatatatataacaaataatatattaaaaaacccatccatcaactaaaacattatatgtatacatcagtatagtgttttattataaagccaattatctgattaagcattctttccactgaatgcataatgtttaaatagcataaaatgaaatgctacaaaaattgaactaatttatactttaaagtatttctgggttaaatgaaacaatgaaattttttagtatgttcaactctcatccaaatggcatatgaccctgtttacacagcctaaagctaaaaatattactctagtttattctaatctattgttaagtattgtgcactgtataccaagttcttagggcacatgaaaaattttagctgccaaacaggaactagtaaacatatgttcctaataagtgaagggaaagataataatgatggtcaacaataagccacgtcaatgcataagttgtataggctaaatgttgcttgtaggctacattaaactcaaatgtaatagttatcttatactcctggtttgatttgattagcatattaacgtgaaagtaggatagctactaaatatatattatgcaagtcaggaatcattaatttcaaaatttaaagccatgctaaaattaaaaagaaaatattaaattacacaattacacttgtctttactggccatacaaaatgattttttttttttttttgagacagagtcttgctctgtcaccaggctggagtgcagtggcatgatctcggctcactgcaacctccaactccctggtttaagggattctcctgcctcagcctcccaagtagctgggattacagactcatgccaccacgccagctaatttttgtatttttagtagagacggggtttcaccatgttggtcaggatggtctcaatcctggcctcttgatagtcctgacctcatgatctgcccacctcggcctccccaaagtgctgggattacaggtacaatgatgtataattaatgcttagtgaagcataaagttacctacatcaattaattaaatgaacttatgtacagaaaacatgtataaatataagtctatactaatgcttacaactttctaagagggttcttgcttatgtagctttttattattttaagtaactagaaccaccaaatatcaaataaaattatttggttatggttatgttcatctaaacacaacaataacttttatattaatatttaggagtctattttgtctataggtgacaaacatctccagactaacatgtcagttttatcaattatattatgtttaattatttaagatttctttatgtggaacatctatagagataaatagaaattttcaataagatgtagtaacactgtgatttatctttcaagagtctctcttcacttccttctaaagagactaatttgagagtacaggtgcatattaattttcttggttctttcagctgaattatattggtccagaagttcaaaatcatgtgacaataataagggatactgacagaagttatttccaagtttgtgtatatattataaaaattacatatataaaactaaggcttttatttctgttatttttaagcttttatttcttgtagctaaaaataaaacatcataaatcttcttattaaatcaatcttgtaaatagaaaatgtaataactttcttaccattaacatttttttacccttccatagaagggagggaataaatcatgacttatcccattttcaataacaaaacgaactatggcactaaccaaaaacttgcattctggcataatttttacagttgcagagaattgtttctgggctcattaaaaaaagtagtattgcagacattgctgcaatgggaagcagacaataacttcttaaaggaattctacacctcctttaagatttacttaattgctacatctaaattctgataatttaaaatccattttaggtgataaaattttttaaaagttttgaaggaaacctctggataaatggacaaggcctaatttttttttgtagtcaatccaactgtactggccaatttttgaaataagattatatgattaggtattagcagagacaaagagttacctcctccatcttactctgccctatttgaaagtctcaggggagaaaagggaacaagatgctgatccaacctgagtggagtcaggtgaggcatctttacatctaagaatttttttttaaattttattattattatacttcaagttctagggtacatgtccacaatgcacatgtctgtcacacatgcacacatgtgccatgctggtgtgctgcacccaccaacctgtcatccagcattaggtatatctcctaatgctatccctcccctctccacccaccccacagcaggccccggtatgtgatgttccccttcgtgtgtccatgtgttcttattgttcaattcccacctatgagtgagaatatgtggtgtttggtttttggtccttgcaacagtttgctgagaatgatggtttccagcttcatccatgtccctacaaagaacatgaactcatcattttttatggctgcatagtattccatggtgtatatgtgccacattttcttaatccagtctatcattgttggacatttgggttggttccaagtctttgctattgtgaatagtgctgcaataaacatatgtgtg

SEQ ID NO: 71450 - DNA, 1877 bp, Homo sapiens
  misc_feature (24)..(24): n is a, c, g, or t
tggattacttggccaggcgtggtngctcatgcctgtaaatcccagtagtttgggaggccgaggtgagtggataacatgttggtcaggatggtctcaatcctggcctcttgatagtcctgacctcatgatctgcccacctcggcctccccaaagtgctgggattacaggtacaatgatgtataattaatgcttagtgaagcataaagttacctacatcaattaattaaatgaacttatgtacagaaaacatgtataaatataagtctatactaatgcttacaactttctaagagggttcttgcttatgtagctttttattattttaagtaactagaaccaccaaatatcaaataaaattatttggttatggttatgttcatctaaacacaacaataacttttatattaatatttaggagtctattttgtctataggtgacaaacatctccagactaacatgtcagttttatcaattatattatgtttaattatttaagatttctttatgtggaacatctatagagataaatagaaattttcaataagatgtagtaacactgtgatttatctttcaagagtctctcttcacttccttctaaagagactaatttgagagtacaggtgcatattaattttcttggttctttcagctgaattatattggtccagaagttcaaaatcatgtgacaataataagggatactgacagaagttatttccaagtttgtgtatatattataaaaattacatatataaaactaaggcttttatttctgttatttttaagcttttatttcttgtagctaaaaataaaacatcataaatcttcttattaaatcaatcttgtaaatagaaaatgtaataactttcttaccattaacatttttttacccttccatagaagggagggaataaatcatgacttatcccattttcaataacaaaacgaactatggcactaaccaaaaacttgcattctggcataatttttacagttgcagagaattgtttctgggctcattaaaaaaagtagtattgcagacattgctgcaatgggaagcagacaataacttcttaaaggaattctacacctcctttaagatttacttaattgctacatctaaattctgataatttaaaatccattttaggtgataaaattttttaaaagttttgaaggaaacctctggataaatggacaaggcctaatttttttttgtagtcaatccaactgtactggccaatttttgaaataagattatatgattaggtattagcagagacaaagagttacctcctccatcttactctgccctatttgaaagtctcaggggagaaaagggaacaagatgctgatccaacctgagtggagtcaggtgaggcatctttacatctaagaatttttttttaaattttattattattatacttcaagttctagggtacatgtccacaatgcacatgtctgtcacacatgcacacatgtgccatgctggtgtgctgcacccaccaacctgtcatccagcattaggtatatctcctaatgctatccctcccctctccacccaccccacagcaggccccggtatgtgatgttccccttcgtgtgtccatgtgttcttattgttcaattcccacctatgagtgagaatatgtggtgtttggtttttggtccttgcaacagtttgctgagaatgatggtttccagcttcatccatgtccctacaaagaacatgaactcatcattttttatggctgcatagtattccatggtgtatatgtgccacattttcttaatccagtctatcattgttggacatttgggttggttccaagtctttgctattgtgaatagtgctgcaataaacatatgtgtg

SEQ ID NO: 71451 - DNA, 5261 bp, Homo sapiens
ggggaagcttcgcaggcgtgcacggagcagtgagatcactggcgttataaatatcccggtgccagcgcggagatccgctcgggtggcctctctcttcccctctccccttctcttccccgaggctatgtccacccggtgcggcgaggcgggcagagccagaggcacgcagccgcacaggggctacagagcccagaatcagccctacaagatgcacttaggacccccgcggctggaagaatgagcttgtccttcctcctcctcctcttcttcagccacctgatcctcagcgcctgggctcacggggagaagcgtctcgcccccaaagggcaacccggacccgctgccactgataggaaccctagaggctccagcagcagacagagcagcagtagcgctatgtcttcctcttctgcctcctcctcccccgcagcttctctgggcagccaaggaagtggcttggagcagagcagtttccagtggagcccctcggggcgccggaccggcagcctctactgcagagtgggcatcggtttccatctgcagatctacccggatggcaaagtcaatggatcccacgaagccaatatgttaagccaagttcacagatgactgcaagttcagggagcgttttcaagaaaatagctataatacctatgcctcagcaatacatagaactgaaaaaacagggcgggagtggtatgtggccctgaataaaagaggaaaagccaaacgagggtgcagcccccgggttaaaccccagcatatctctacccattttctgccaagattcaagcagtcggagcagccagaactttctttcacggttactgttcctgaaaagaaaaagccacctagccctatcaagccaaagattcccctttctgcacctcggaaaaataccaactcagtgaaatacagactcaagtttcgctttggataatattcctcttggccttgtgagaaaccattctttcccctcaggagtttctataggtgtcttcagagttctgaagaaaaattactggacacagcttcagctatacttacactgtattgaagtcacgtcatttgtttcaatgtgactgaaacaaaatgttttttgataggaaggaaactggaattctttgtactaatacagggagcacactccttcagttcagcaagacataaagccttttgctttatgcttgagggatatttagaactttgtattttcggaaagttaaataacagggactacgtatttttctgacttttacagattaacctgaaagaacatacatgatacatttttatttttggtttccaaagaatattttgatgcagataaaatattttgttaacttttgtttttttttgtttgttttcttaaaagtacctctgcattgagcatattttcttacttttattattttaattaatatgacataagcaatcattttatgctgtttatgaattataaatgtgtttatagctcatttgtaatatggaaatcttttacatttttcctattcactgcacttttttattgtttttatttctagccatacctcagataatatgtttagttttacattttaaaatgtttaaattctctttcacagcaccaaaggctcagcttggatttgtgtgtatgtgtatgtcaattcatgacattatgtggaatcctaaacctttggtggctgggatatgatgggttagaagcaaggagaaaatataaggactttttgatggaattaaatgtgggaggtaaggaaaaggatttagaggtaaaagtacactaagtttgcaacatttattgagatctaagtctgtcttgccttcatttctctttttatctcccccttgccctcattcttgaacagctggaggaatacattttattctgtccatgaagcatacactatgaaattcaagtgcttaaaaatacttctatgactctctgctatcccactgtatagatccacagggagcaaacacttagaaatgatagagaactgaaggagatcaatggtttaacagttatccatgccaagtcccattgtcagaaatattcttattactcagtcaaacactctttgagcttcccttcctaaaggtaaccattccagtgaatagatgtgcccttttataaggaaacttctgatgtttattaaaaaaactggccttttgatagaggtaacttaatttgggaatttgttgtgttgaaatggcatttaatttcaacctaaatactgactgctggacataaatcacagaaaatttaacttaagaaaatttacaaaatttattctcaggtaatcattttaataaagttctgcaaaatacacgtttatcttacattcagaaatgtggcaaaaaaggcatagctaaaggctaaacatatggctttagtagtaacaaaagggttcatagaaacttcatggtttgcatttaaacatgtttaaagtgtacttataaactatttttttcttaaagcaaactatgatttattttggtgcacaaatacaaagtggaaacttaccaaaattgaactagctaccatataagcagattgctttaatttgatgggaaaatagtacacacatatatataacaaataatatattaaaaaacccatccatcaactaaaacattatatgtatacatcagtatagtgttttattataaagccaattatctgattaagcattctttccactgaatgcataatgtttaaatagcataaaatgaaatgctacaaaaattgaactaatttatactttaaagtatttctgggttaaatgaaacaatgaaattttttagtatgttcaactctcatccaaatggcatatgaccctgtttacacagcctaaagctaaaaatattactctagtttattctaatctattgttaagtattgtgcactgtataccaagttcttagggcacatgaaaaattttagctgccaaacaggaactagtaaacatatgttcctaataagtgaagggaaagataataatgatggtcaacaataagccacgtcaatgcataagttgtataggctaaatgttgcttgtaggctacattaaactcaaatgtaatagttatcttatactcctggtttgatttgattagcatattaacgtgaaagtaggatagctactaaatatatattatgcaagtcaggaatcattaatttcaaaatttaaagccatgctaaaattaaaaagaaaatattaaattacacaattacacttgtctttactggccatacaaaatgattttttttttttttttgagacagagtcttgctctgtcaccaggctggagtgcagtggcatgatctcggctcactgcaacctccaactccctggtttaagggattctcctgcctcagcctcccaagtagctgggattacagactcatgccaccacgccagctaatttttgtatttttagtagagacggggtttcaccatgttggtcaggatggtctcaatcctggcctcttgatagtcctgacctcatgatctgcccacctcggcctccccaaagtgctgggattacaggtacaatgatgtataattaatgcttagtgaagcataaagttacctacatcaattaattaaatgaacttatgtacagaaaacatgtataaatataagtctatactaatgcttacaactttctaagagggttcttgcttatgtagctttttattattttaagtaactagaaccaccaaatatcaaataaaattatttggttatggttatgttcatctaaacacaacaataacttttatattaatatttaggagtctattttgtctataggtgacaaacatctccagactaacatgtcagttttatcaattatattatgtttaattatttaagatttctttatgtggaacatctatagagataaatagaaattttcaataagatgtagtaacactgtgatttatctttcaagagtctctcttcacttccttctaaagagactaatttgagagtacaggtgcatattaattttcttggttctttcagctgaattatattggtccagaagttcaaaatcatgtgacaataataagggatactgacagaagttatttccaagtttgtgtatatattataaaaattacatatataaaactaaggcttttatttctgttatttttaagcttttatttcttgtagctaaaaataaaacatcataaatcttcttattaaatcaatcttgtaaatagaaaatgtaataactttcttaccattaacatttttttacccttccatagaagggagggaataaatcatgacttatcccattttcaataacaaaacgaactatggcactaaccaaaaacttgcattctggcataatttttacagttgcagagaattgtttctgggctcattaaaaaaagtagtattgcagacattgctgcaatgggaagcagacaataacttcttaaaggaattctacacctcctttaagatttacttaattgctacatctaaattctgataatttaaaatccattttaggtgataaaattttttaaaagttttgaaggaaacctctggataaatggacaaggcctaatttttttttgtagtcaatccaactgtactggccaatttttgaaataagattatatgattaggtattagcagagacaaagagttacctcctccatcttactctgccctatttgaaagtctcaggggagaaaagggaacaagatgctgatccaacctgagtggagtcaggtgaggcatctttacatctaagaatttttttttaaattttattattattatacttcaagttctagggtacatgtccacaatgcacatgtctgtcacacatgcacacatgtgccatgctggtgtgctgcacccaccaacctgtcatccagcattaggtatatctcctaatgctatccctcccctctccacccaccccacagcaggccccggtatgtgatgttccccttcgtgtgtccatgtgttcttattgttcaattcccacctatgagtgagaatatgtggtgtttggtttttggtccttgcaacagtttgctgagaatgatggtttccagcttcatccatgtccctacaaagaacatgaactcatcattttttatggctgcatagtattccatggtgtatatgtgccacattttcttaatccagtctatcattgttggacatttgggttggttccaagtctttgctattgtgaatagtgctgcaataaacatatgtgtg

SEQ ID NO: 71452 - DNA, 3265 bp, Homo sapiens
tccgctcgtcgacgggcctcgagcgaaacgataacagcaaccagagctccatcgcagatgcctcccccatcaaacaggagaacagcagcaactccagccccgctccagagcccaactcggctgtgcccagcgacggcaccgaggccaaggtggatgaggcccaggctgatgggaaggagcacccaggagctgaagatgcttctgatgagcagaattcacagtcctcgatggaacattcgatgaacagctcagagaaagtagatcggcagccgtctggagactcgggtctggccgcagagacgtctgcaatctctcaggatctggaaggagtgccaccctctaaaaagatgaaactggaggcctctcaacaaaactccgaagagatgtagacgatgctttaaagcctccgatccatgttccatggaaggtacatcagcaattaattctagagcaactttgccccagcgattcctcttgggtgcgaacagaactactaacgtttcaagtttaccaagtgcaaatccaagaagacccagaacggcgtcacttctcagacactgaagaactctgctgtgaagcaaaacactcaaacctttaagggactgtccttggggaggcaggcggggctgacagctcaggagtgtctgcacactgtctcggaagccaggattccatttgtgttgctgctgtattttccccccacttctctatgtaacgatataagctatcggagggtggtaccgatcaggaacgctttttggcggggctttccactgttcaaccgattccttccgctttctttttttgtgccttgtgcccttgaggtgacctctggcatgtatcctggtggttcttacatccccctctgcaaagtgccctcttggtttggttcgggcggcggctgccaccctactcaccgctctcctccctgccccaggacttcatcggagcaggcagggtggagcgaaggagctccttagcccacctggtttgcaggtgcagggggaccttaggcacgccccaagcaccaggcaccagggcccaaggacgcgcaggtgttggggcacagtccccaagggctcggccccttggatcaggctgggcactcgctgtgctctcccctccttggggcgtttaggactgggcgtctccaagcccaccatggcccagatggacgtgcaaagcccttggaattttctggcacttcctctctattgcccccaccaccaccacccccatcactgctttctcccagacctccgaatacgaaatggcttctctggctgactgcaaggctgtctccttaaggcactgagtgggccggggaggctgggagccggcggcaggattagctggtgctgaactttctctcataggacgtcgcttggatttcaaatccacggtcacctgctgccctttgcctcccccgacgccccagcctgtgccccggagaggcaggatcgcagtggtcagaatccacgtgctttcctattctcaggctgttctgactctgagccaacagctggaccgtgtctcatccccagaacatgccgtctgtccaccggggagtggccttgatggccggcctcgaaggccacaaacaaggcgtcgaggaattggaaagatttgcacaccctccagaaaggagagacgcaatctcccctccctcccatcccccaccttcgctggaacagcttcctctcactgaacggagacgcccccttggacgaactgcctaatcgtttggttctgaggcctggtttgctcttaattaatatatgaactcctcagaccttaaaccttttcctaagctttctttactgcactggagttctgactccctttgagttgtgtgttactgggggtggggtggggtcatgggttttgttgtttttgggggctaattggtgcatattcaggtaccacctttgacgtgtggctctttctcctgaccatcatgggaagtgtctgctggattccattttctaagagtttctgagggtgaggctcttattttttttttaagggatcctgtctatttcctgcacttcgagaagaatcaaaatgttcctgaatttcaaatacctcatgcaaaatgtgtctcctgaaataagggaaaaaaaaaaaaaaccacaactttgaaaatcttaatgttgaagttagcaatgccgaaaggtttctgtcttaaaaaaaaaaaatccttgtacttatcaattttgccccttaggcagtcagttttgttgagaactgtgtcctgcatcctggcgcagaacctcctgatgcggttcctctccacgcatctcgaggcggcgttacctccagattccgtagagttagagtcacatttttctttgcagcgaaactccgtcttggtgagagatgaatttggatatttatttccttctctgtttttgggaaacgagaggctacaaccaagacagctgaaggagaatgaaacacacatccacagaaacagagaggcgtaggtggccctgccgttgaccgcagcctctctggacaggcaaggggagttggcgcaggtgaggactcagacgacgtccaccgtcccaaggctgtcactagtatttctctgaagtgcctgaaggtaggaatgggccggcgattgggaccagctgggccccaccacggccacgccaggcaaagcgccagcagccctgcactccacgctggccaagaaggccttccacgcagaatgacaagactgcaaaaatccgatgtgcttccttccctggcgcagtcgctcctcgagccgctgccccccacccaccctgcacccctcgccctcccccccaccacagaatctaagacctttcagcttcgagccagggggcgggggatcccgagcaaaagccttccatggacatcaggccccgtggcctcaagggctcccagggcaaacctaattcccccaaaacgtgaagtcggggaagctgcggctacacattccacaaagtgctggcacttacacccacaacccggaaggctgtggaccgattcctctagggtggtgacctcccattagcaaacggtgtcatggtttggaatgttcattatcgccaagaacctggttagaggcataaagaccttttttcaccgttacctaattttttcccctttcaagaattttttttttttttggtgtgttgtacagcagtataatttttcacttatttattcctacagtagatatggtttgtacaatgtacaattgtttcatttcagaaaataaaaatttcaaatcatg

SEQ ID NO: 71453 - DNA, 5824 bp, Homo sapiens
tttgtcctactgttcttttattcccacggttttacccctgctctttgttcgatattttgtatatcgtctttccttcattttgcgggtgtgccgtgctggtgtctttacccccctgtttgtcactcgactatttctgggtcatccgttctccatctcttttagttccccacgtgttcgccccgttgtgtcttataccctcttttttgttcgcggtctcttggttttttggtggtgccttgtgggtgttttgttcgttttttctttgcttttttcttgagacttccgtgttttgctctgttgcccaggctggagtgcaatggcatgatcattgcacctctgcctcccaggttcaagcattttcctgcctcagcctcccgcgtagctcagattacaggcctgcaccaccacgcccagctaatttttgtatttttagtagagacagggtttctccatgttggccaggctggtctcgaactcctgacctcgtgatctgcccacttcggcctccaaagtgctgggattacaggcatgaaccaccgcgcccggccttttttttttttctgagacagggtctcactctgtctcccaggctggagtgcagtggctggatctctgctcactgcaacctccgtctcccaggttcaagcgagtctcctgcctcagactcccgagtagctgcgattacaggagcccaccaccgcgcccggctaatttttgtatttttagtagagacggggtttcacccaccatgttggccaggctggtatcgaactcttaacctcaagtgatccacccgcctcggcctcccaaagtgctggtattacaggcatgagccaccgcgcccggccagtatttgttcttttcttcatttttcacgtcaggagactgcgtttcagaatagtaaaaacaaatgcctaggaaaaggcctgcggtctctccatttccacagtagcgtgttccccaaagaccaaaccctcaggggaaacgtctagaatgagtaacaacttaaggctgcaaccttaaactttcccaggactcagtttccccagctgtgaaatggctgctgtcgggctgtcatctccaggcccggggcgctgacatttgggccactctcggtctccctcttcattctgggcgcgcattagctctggtccggccggttccgctgcagctgaacagcaagatgcggcacccaggttaccctgatcatcgcagatttctccccggggctctgttctgaggcctcaaaagtgctccttgtagatgggaccaggggtcatttgggcagtagcagcgcctggtctcagtctggtactgaagtcaggaatggcttaaggtgaaatcgtggtcctctggtgaagctcagcgaagaccccctcgccttgtttatgacaagagaacttctgggggcgggaggaagagtccctgttacgatgctgatcatcattgagcttttgctgagaaaactctttagtactaaggtcgagagtctctgtggtctgcctggcaccagcaccttcctacaaccctagttttccaaaaggaaaagcctggggccaggcgacgtcctagctcgcattatgacagggccgcgggccaccagagatgcgcgatgcccaactctttccaagagcacctcgcgtcccgaaccggtgccttcaactcggagaagtcaagagacccgcaagaaacttgcacgactgcacccgccgccgcgctgctgggggctgggcaggggcagctgggctggctcccggggagacgcgacccccccgcgccccgcagaccggctgtctcccatggacccctcggcacctgcagctccgaggaagggtcagcgcgcgtgtccgcaccccgcccccaccgcgcgcccagagccgggggtcgccgtggcccttcgccacctccccaggagggcgtccggggcgtcccctctgggcgacgcgaggcccggggggctgcggtggccgcggcgcggagccgcactccggcggcggcggcggcgcggctccccctgctctgtgcagctgccgcccgggcttgcgctgggccaggcgcgcggcggccccgggctttgtgtgtgtgtatgtgtgtgtgtgtgtgtgtgtgtgtgtgtgagagtgtgtgcgtgtgagagtgcgagtgtctgtgcgcgagtgagtgagcggcgggcgggcgcgagtgtggccgccgcggagcgcgagcaggacccggcgggcgcgctccccagcctccgtctccccgccggaaccatgtcgggcaggtcggttcgagccgagacgaggagccgggccaaagatgatatcaagagggtcatggcggcgatcgagaaagtgcgcaaatgggagaagaaatgggtgaccgttggtgacacatccctacgaatctacaaatgggtccctgtgacggagcccaaggttgatgacaaaaacaagaataagaaaaaaggcaaggacgagaagtgtggctcagaggtgaccactccggagaacagttcctccccagggatgatggacatgcatgacgataacagcaaccagagctccatcgcagatgcctcccccatcaaacaggagaacagcagcaactccagccccgctccagagcccaactcggctgtgcccagcgacggcaccgaggccaaggtggatgaggcccaggctgatgggaaggagcacccaggagctgaagatgcttctgatgagcagaattcacagtcctcgatggaacattcgatgaacagctcagagaaagtagatcggcagccgtctggagactcgggtctggccgcagagacgtctgcaatctctcaggtacctcgctcgaggtctcagaggggcagccagatcggccgggagcccattgggttgtcgggggatctggaaggagtgccaccctctaaaaagatgaaactggaggcctctcaacaaaactccgaagagatgtagacgatgctttaaagcctccgatccatgttccatggaaggtacatcagcaattaattctagagcaactttgccccagcgattcctcttgggtgcgaacagaactactaacgtttcaagtttaccaagtgcaaatccaagaagacccagaacggcgtcacttctcagacactgaagaactctgctgtgaagcaaaacactcaaacctttaagggactgtccttggggaggcaggcggggctgacagctcaggagtgtctgcacactgtctcggaagccaggattccatttgtgttgctgctgtattttccccccacttctctatgtaacgatataagctatcggagggtggtaccgatcaggaacgctttttggcggggctttccactgttcaaccgattccttccgctttctttttttgtgccttgtgcccttgaggtgacctctggcatgtatcctggtggttcttacatccccctctgcaaagtgccctcttggtttggttcgggcggcggctgccaccctactcaccgctctcctccctgccccaggacttcatcggagcaggcagggtggagcgaaggagctccttagcccacctggtttgcaggtgcagggggaccttaggcacgccccaagcaccaggcaccagggcccaaggacgcgcaggtgttggggcacagtccccaagggctcggccccttggatcaggctgggcactcgctgtgctctcccctccttggggcgtttaggactgggcgtctccaagcccaccatggcccagatggacgtgcaaagcccttggaattttctggcacttcctctctattgcccccaccaccaccacccccatcactgctttctcccagacctccgaatacgaaatggcttctctggctgactgcaaggctgtctccttaaggcactgagtgggccggggaggctgggagccggcggcaggattagctggtgctgaactttctctcataggacgtcgcttggatttcaaatccacggtcacctgctgccctttgcctcccccgacgccccagcctgtgccccggagaggcaggatcgcagtggtcagaatccacgtgctttcctattctcaggctgttctgactctgagccaacagctggaccgtgtctcatccccagaacatgccgtctgtccaccggggagtggccttgatggccggcctcgaaggccacaaacaaggcgtcgaggaattggaaagatttgcacaccctccagaaaggagagacgcaatctcccctccctcccatcccccaccttcgctggaacagcttcctctcactgaacggagacgcccccttggacgaactgcctaatcgtttggttctgaggcctggtttgctcttaattaatatatgaactcctcagaccttaaaccttttcctaagctttctttactgcactggagttctgactccctttgagttgtgtgttactgggggtggggtggggtcatgggttttgttgtttttgggggctaattggtgcatattcaggtaccacctttgacgtgtggctctttctcctgaccatcatgggaagtgtctgctggattccattttctaagagtttctgagggtgaggctcttattttttttttaagggatcctgtctatttcctgcacttcgagaagaatcaaaatgttcctgaatttcaaatacctcatgcaaaatgtgtctcctgaaataagggaaaaaaaaaaaaaaccacaactttgaaaatcttaatgttgaagttagcaatgccgaaaggtttctgtcttaaaaaaaaaaaatccttgtacttatcaattttgccccttaggcagtcagttttgttgagaactgtgtcctgcatcctggcgcagaacctcctgatgcggttcctctccacgcatctcgaggcggcgttacctccagattccgtagagttagagtcacatttttctttgcagcgaaactccgtcttggtgagagatgaatttggatatttatttccttctctgtttttgggaaacgagaggctacaaccaagacagctgaaggagaatgaaacacacatccacagaaacagagaggcgtaggtggccctgccgttgaccgcagcctctctggacaggcaaggggagttggcgcaggtgaggactcagacgacgtccaccgtcccaaggctgtcactagtatttctctgaagtgcctgaaggtaggaatgggccggcgattgggaccagctgggccccaccacggccacgccaggcaaagcgccagcagccctgcactccacgctggccaagaaggccttccacgcagaatgacaagactgcaaaaatccgatgtgcttccttccctggcgcagtcgctcctcgagccgctgccccccacccaccctgcacccctcgccctcccccccaccacagaatctaagacctttcagcttcgagccagggggcgggggatcccgagcaaaagccttccatggacatcaggccccgtggcctcaagggctcccagggcaaacctaattcccccaaaacgtgaagtcggggaagctgcggctacacattccacaaagtgctggcacttacacccacaacccggaaggctgtggaccgattcctctagggtggtgacctcccattagcaaacggtgtcatggtttggaatgttcattatcgccaagaacctggttagaggcataaagaccttttttcaccgttacctaattttttcccctttcaagaattttttttttttttggtgtgttgtacagcagtataatttttcacttatttattcctacagtagatatggtttgtacaatgtacaattgtttcatttcagaaaataaaaatttcaaatcatg

SEQ ID NO: 71454 - DNA, 3010 bp, Homo sapiens
tttgtcctactgttcttttattcccacggttttacccctgctctttgttcgatattttgtatatcgtctttccttcattttgcgggtgtgccgtgctggtgtctttacccccctgtttgtcactcgactatttctgggtcatccgttctccatctcttttagttccccacgtgttcgccccgttgtgtcttataccctcttttttgttcgcggtctcttggttttttggtggtgccttgtgggtgttttgttcgttttttctttgcttttttcttgagacttccgtgttttgctctgttgcccaggctggagtgcaatggcatgatcattgcacctctgcctcccaggttcaagcattttcctgcctcagcctcccgcgtagctcagattacaggcctgcaccaccacgcccagctaatttttgtatttttagtagagacagggtttctccatgttggccaggctggtctcgaactcctgacctcgtgatctgcccacttcggcctccaaagtgctgggattacaggcatgaaccaccgcgcccggccttttttttttttctgagacagggtctcactctgtctcccaggctggagtgcagtggctggatctctgctcactgcaacctccgtctcccaggttcaagcgagtctcctgcctcagactcccgagtagctgcgattacaggagcccaccaccgcgcccggctaatttttgtatttttagtagagacggggtttcacccaccatgttggccaggctggtatcgaactcttaacctcaagtgatccacccgcctcggcctcccaaagtgctggtattacaggcatgagccaccgcgcccggccagtatttgttcttttcttcatttttcacgtcaggagactgcgtttcagaatagtaaaaacaaatgcctaggaaaaggcctgcggtctctccatttccacagtagcgtgttccccaaagaccaaaccctcaggggaaacgtctagaatgagtaacaacttaaggctgcaaccttaaactttcccaggactcagtttccccagctgtgaaatggctgctgtcgggctgtcatctccaggcccggggcgctgacatttgggccactctcggtctccctcttcattctgggcgcgcattagctctggtccggccggttccgctgcagctgaacagcaagatgcggcacccaggttaccctgatcatcgcagatttctccccggggctctgttctgaggcctcaaaagtgctccttgtagatgggaccaggggtcatttgggcagtagcagcgcctggtctcagtctggtactgaagtcaggaatggcttaaggtgaaatcgtggtcctctggtgaagctcagcgaagaccccctcgccttgtttatgacaagagaacttctgggggcgggaggaagagtccctgttacgatgctgatcatcattgagcttttgctgagaaaactctttagtactaaggtcgagagtctctgtggtctgcctggcaccagcaccttcctacaaccctagttttccaaaaggaaaagcctggggccaggcgacgtcctagctcgcattatgacagggccgcgggccaccagagatgcgcgatgcccaactctttccaagagcacctcgcgtcccgaaccggtgccttcaactcggagaagtcaagagacccgcaagaaacttgcacgactgcacccgccgccgcgctgctgggggctgggcaggggcagctgggctggctcccggggagacgcgacccccccgcgccccgcagaccggctgtctcccatggacccctcggcacctgcagctccgaggaagggtcagcgcgcgtgtccgcaccccgcccccaccgcgcgcccagagccgggggtcgccgtggcccttcgccacctccccaggagggcgtccggggcgtcccctctgggcgacgcgaggcccggggggctgcggtggccgcggcgcggagccgcactccggcggcggcggcggcgcggctccccctgctctgtgcagctgccgcccgggcttgcgctgggccaggcgcgcggcggccccgggctttgtgtgtgtgtatgtgtgtgtgtgtgtgtgtgtgtgtgtgtgagagtgtgtgcgtgtgagagtgcgagtgtctgtgcgcgagtgagtgagcggcgggcgggcgcgagtgtggccgccgcggagcgcgagcaggacccggcgggcgcgctccccagcctccgtctccccgccggaaccatgtcgggcaggtcggttcgagccgagacgaggagccgggccaaagatgatatcaagagggtcatggcggcgatcgagaaagtgcgcaaatgggagaagaaatgggtgaccgttggtgacacatccctacgaatctacaaatgggtccctgtgacggagcccaaggttgatgacaaaaacaagaataagaaaaaaggcaaggacgagaagtgtggctcagaggtgaccactccggagaacagttcctccccagggatgatggacatgcatggtgagtgcccatggcctgccagcctctcctgcccagcccggggccttggccaagcactcggtcatgtttttgtttctccagcaggtttgttcacattccaggcaaggggtaggagggctgggcagggcccggcggcctctgtgccaaggagaagagtcagcggaggagaggatgtttcttttcccagcgtaccaagccaagagacataaactaagccagagacatagaaattagaccctctcctcacccagggacaagaaccccgcaggagatgtttctctcagcctcgtgtgtccaggaagattgtttgggcgtatgtttcttcgccccctcatataaattatataaatggctgtgtttcccattttgctttggctgctgggaatctccaaactggattttgtttgtttgttttgttttgttttgtttttgagatggagttttgctctgttgaccagcctgggcaagagagtgaggccttgtctcc

SEQ ID NO: 71455 - DNA, 3707 bp, Homo sapiens
ccaagtgcaaatccaagaagacccagaacggcgtcacttctcagacactgaagaactctgctgagagtgtgtgcgtgtgagagtgcgagtgtctgtgcgcgagtgagtgagcggcgggcgggcgcgagtgtggccgccgcggagcgcgagcaggacccggcgggcgcgctccccagcctccgtctccccgccggaaccatgtcgggcaggtcggttcgagccgagacgaggagccgggccaaagatgatatcaagagggtcatggcggcgatcgagaaagtgcgcaaatgggagaagaaatgggtgaccgttggtgacacatccctacgaatctacaaatgggtccctgtgacggagcccaaggttgatgacaaaaacaagaataagaaaaaaggcaaggacgagaagtgtggctcagaggtgaccactccggagaacagttcctccccagggatgatggacatgcatgacgataacagcaaccagagctccatcgcagatgcctcccccatcaaacaggagaacagcagcaactccagccccgctccagagcccaactcggctgtgcccagcgacggcaccgaggccaaggtggatgaggcccaggctgatgggaaggagcacccaggagctgaagatgcttctgatgagcagaattcacagtcctcgatggaacattcgatgaacagctcagagaaagtagatcggcagccgtctggagactcgggtctggccgcagagacgtctgcaatctctcaggatctggaaggagtgccaccctctaaaaagatgaaactggaggcctctcaacaaaactccgaagagatgtagacgatgctttaaagcctccgatccatgttccatggaaggtacatcagcaattaattctagagcaactttgccccagcgattcctcttgggtgcgaacagaactactaacgtttcaagtttaccaagtgcaaatccaagaagacccagaacggcgtcacttctcagacactgaagaactctgctgtgaagcaaaacactcaaacctttaagggactgtccttggggaggcaggcggggctgacagctcaggagtgtctgcacactgtctcggaagccaggattccatttgtgttgctgctgtattttccccccacttctctatgtaacgatataagctatcggagggtggtaccgatcaggaacgctttttggcggggctttccactgttcaaccgattccttccgctttctttttttgtgccttgtgcccttgaggtgacctctggcatgtatcctggtggttcttacatccccctctgcaaagtgccctcttggtttggttcgggcggcggctgccaccctactcaccgctctcctccctgccccaggacttcatcggagcaggcagggtggagcgaaggagctccttagcccacctggtttgcaggtgcagggggaccttaggcacgccccaagcaccaggcaccagggcccaaggacgcgcaggtgttggggcacagtccccaagggctcggccccttggatcaggctgggcactcgctgtgctctcccctccttggggcgtttaggactgggcgtctccaagcccaccatggcccagatggacgtgcaaagcccttggaattttctggcacttcctctctattgcccccaccaccaccacccccatcactgctttctcccagacctccgaatacgaaatggcttctctggctgactgcaaggctgtctccttaaggcactgagtgggccggggaggctgggagccggcggcaggattagctggtgctgaactttctctcataggacgtcgcttggatttcaaatccacggtcacctgctgccctttgcctcccccgacgccccagcctgtgccccggagaggcaggatcgcagtggtcagaatccacgtgctttcctattctcaggctgttctgactctgagccaacagctggaccgtgtctcatccccagaacatgccgtctgtccaccggggagtggccttgatggccggcctcgaaggccacaaacaaggcgtcgaggaattggaaagatttgcacaccctccagaaaggagagacgcaatctcccctccctcccatcccccaccttcgctggaacagcttcctctcactgaacggagacgcccccttggacgaactgcctaatcgtttggttctgaggcctggtttgctcttaattaatatatgaactcctcagaccttaaaccttttcctaagctttctttactgcactggagttctgactccctttgagttgtgtgttactgggggtggggtggggtcatgggttttgttgtttttgggggctaattggtgcatattcaggtaccacctttgacgtgtggctctttctcctgaccatcatgggaagtgtctgctggattccattttctaagagtttctgagggtgaggctcttattttttttttaagggatcctgtctatttcctgcacttcgagaagaatcaaaatgttcctgaatttcaaatacctcatgcaaaatgtgtctcctgaaataagggaaaaaaaaaaaaaaccacaactttgaaaatcttaatgttgaagttagcaatgccgaaaggtttctgtcttaaaaaaaaaaaatccttgtacttatcaattttgccccttaggcagtcagttttgttgagaactgtgtcctgcatcctggcgcagaacctcctgatgcggttcctctccacgcatctcgaggcggcgttacctccagattccgtagagttagagtcacatttttctttgcagcgaaactccgtcttggtgagagatgaatttggatatttatttccttctctgtttttgggaaacgagaggctacaaccaagacagctgaaggagaatgaaacacacatccacagaaacagagaggcgtaggtggccctgccgttgaccgcagcctctctggacaggcaaggggagttggcgcaggtgaggactcagacgacgtccaccgtcccaaggctgtcactagtatttctctgaagtgcctgaaggtaggaatgggccggcgattgggaccagctgggccccaccacggccacgccaggcaaagcgccagcagccctgcactccacgctggccaagaaggccttccacgcagaatgacaagactgcaaaaatccgatgtgcttccttccctggcgcagtcgctcctcgagccgctgccccccacccaccctgcacccctcgccctcccccccaccacagaatctaagacctttcagcttcgagccagggggcgggggatcccgagcaaaagccttccatggacatcaggccccgtggcctcaagggctcccagggcaaacctaattcccccaaaacgtgaagtcggggaagctgcggctacacattccacaaagtgctggcacttacacccacaacccggaaggctgtggaccgattcctctagggtggtgacctcccattagcaaacggtgtcatggtttggaatgttcattatcgccaagaacctggttagaggcataaagaccttttttcaccgttacctaattttttcccctttcaagaattttttttttttttggtgtgttgtacagcagtataatttttcacttatttattcctacagtagatatggtttgtacaatgtacaattgtttcatttcagaaaataaaaatttcaaatcatg

SEQ ID NO: 71456 - DNA, 340 bp, Homo sapiens
taagtgtgcaggagagggttgcagacgccagggtccgtgtgtgacctggctgctggaaacagcgccactgaaaaatcaacaggagactccccagccctccagccccccagctcattgtagccttcaaagaccactggccccaaaactacccgattcaaggtattttcagtatttggccccaccggccccgcctctcacgtgtctgaaaacagctcctgtcgtcttgctcttccctcagatgcttctgatgagcagaattcacagtcctcgatggaacattcgatgaacagctcagagaaagtagatcggcagccgtctggagactcgggtctggccgcag

SEQ ID NO: 71457 - DNA, 5761 bp, Homo sapiens
tttgtcctactgttcttttattcccacggttttacccctgctctttgttcgatattttgtatatcgtctttccttcattttgcgggtgtgccgtgctggtgtctttacccccctgtttgtcactcgactatttctgggtcatccgttctccatctcttttagttccccacgtgttcgccccgttgtgtcttataccctcttttttgttcgcggtctcttggttttttggtggtgccttgtgggtgttttgttcgttttttctttgcttttttcttgagacttccgtgttttgctctgttgcccaggctggagtgcaatggcatgatcattgcacctctgcctcccaggttcaagcattttcctgcctcagcctcccgcgtagctcagattacaggcctgcaccaccacgcccagctaatttttgtatttttagtagagacagggtttctccatgttggccaggctggtctcgaactcctgacctcgtgatctgcccacttcggcctccaaagtgctgggattacaggcatgaaccaccgcgcccggccttttttttttttctgagacagggtctcactctgtctcccaggctggagtgcagtggctggatctctgctcactgcaacctccgtctcccaggttcaagcgagtctcctgcctcagactcccgagtagctgcgattacaggagcccaccaccgcgcccggctaatttttgtatttttagtagagacggggtttcacccaccatgttggccaggctggtatcgaactcttaacctcaagtgatccacccgcctcggcctcccaaagtgctggtattacaggcatgagccaccgcgcccggccagtatttgttcttttcttcatttttcacgtcaggagactgcgtttcagaatagtaaaaacaaatgcctaggaaaaggcctgcggtctctccatttccacagtagcgtgttccccaaagaccaaaccctcaggggaaacgtctagaatgagtaacaacttaaggctgcaaccttaaactttcccaggactcagtttccccagctgtgaaatggctgctgtcgggctgtcatctccaggcccggggcgctgacatttgggccactctcggtctccctcttcattctgggcgcgcattagctctggtccggccggttccgctgcagctgaacagcaagatgcggcacccaggttaccctgatcatcgcagatttctccccggggctctgttctgaggcctcaaaagtgctccttgtagatgggaccaggggtcatttgggcagtagcagcgcctggtctcagtctggtactgaagtcaggaatggcttaaggtgaaatcgtggtcctctggtgaagctcagcgaagaccccctcgccttgtttatgacaagagaacttctgggggcgggaggaagagtccctgttacgatgctgatcatcattgagcttttgctgagaaaactctttagtactaaggtcgagagtctctgtggtctgcctggcaccagcaccttcctacaaccctagttttccaaaaggaaaagcctggggccaggcgacgtcctagctcgcattatgacagggccgcgggccaccagagatgcgcgatgcccaactctttccaagagcacctcgcgtcccgaaccggtgccttcaactcggagaagtcaagagacccgcaagaaacttgcacgactgcacccgccgccgcgctgctgggggctgggcaggggcagctgggctggctcccggggagacgcgacccccccgcgccccgcagaccggctgtctcccatggacccctcggcacctgcagctccgaggaagggtcagcgcgcgtgtccgcaccccgcccccaccgcgcgcccagagccgggggtcgccgtggcccttcgccacctccccaggagggcgtccggggcgtcccctctgggcgacgcgaggcccggggggctgcggtggccgcggcgcggagccgcactccggcggcggcggcggcgcggctccccctgctctgtgcagctgccgcccgggcttgcgctgggccaggcgcgcggcggccccgggctttgtgtgtgtgtatgtgtgtgtgtgtgtgtgtgtgtgtgtgtgagagtgtgtgcgtgtgagagtgcgagtgtctgtgcgcgagtgagtgagcggcgggcgggcgcgagtgtggccgccgcggagcgcgagcaggacccggcgggcgcgctccccagcctccgtctccccgccggaaccatgtcgggcaggtcggttcgagccgagacgaggagccgggccaaagatgatatcaagagggtcatggcggcgatcgagaaagtgcgcaaatgggagaagaaatgggtgaccgttggtgacacatccctacgaatctacaaatgggtccctgtgacggagcccaaggttgatgacaaaaacaagaataagaaaaaaggcaaggacgagaagtgtggctcagaggtgaccactccggagaacagttcctccccagggatgatggacatgcatgacgataacagcaaccagagctccatcgcagatgcctcccccatcaaacaggagaacagcagcaactccagccccgctccagagcccaactcggctgtgcccagcgacggcaccgaggccaaggtggatgaggcccaggctgatgggaaggagcacccaggagctgaagatgcttctgatgagcagaattcacagtcctcgatggaacattcgatgaacagctcagagaaagtagatcggcagccgtctggagactcgggtctggccgcagagacgtctgcaatctctcaggatctggaaggagtgccaccctctaaaaagatgaaactggaggcctctcaacaaaactccgaagagatgtagacgatgctttaaagcctccgatccatgttccatggaaggtacatcagcaattaattctagagcaactttgccccagcgattcctcttgggtgcgaacagaactactaacgtttcaagtttaccaagtgcaaatccaagaagacccagaacggcgtcacttctcagacactgaagaactctgctgtgaagcaaaacactcaaacctttaagggactgtccttggggaggcaggcggggctgacagctcaggagtgtctgcacactgtctcggaagccaggattccatttgtgttgctgctgtattttccccccacttctctatgtaacgatataagctatcggagggtggtaccgatcaggaacgctttttggcggggctttccactgttcaaccgattccttccgctttctttttttgtgccttgtgcccttgaggtgacctctggcatgtatcctggtggttcttacatccccctctgcaaagtgccctcttggtttggttcgggcggcggctgccaccctactcaccgctctcctccctgccccaggacttcatcggagcaggcagggtggagcgaaggagctccttagcccacctggtttgcaggtgcagggggaccttaggcacgccccaagcaccaggcaccagggcccaaggacgcgcaggtgttggggcacagtccccaagggctcggccccttggatcaggctgggcactcgctgtgctctcccctccttggggcgtttaggactgggcgtctccaagcccaccatggcccagatggacgtgcaaagcccttggaattttctggcacttcctctctattgcccccaccaccaccacccccatcactgctttctcccagacctccgaatacgaaatggcttctctggctgactgcaaggctgtctccttaaggcactgagtgggccggggaggctgggagccggcggcaggattagctggtgctgaactttctctcataggacgtcgcttggatttcaaatccacggtcacctgctgccctttgcctcccccgacgccccagcctgtgccccggagaggcaggatcgcagtggtcagaatccacgtgctttcctattctcaggctgttctgactctgagccaacagctggaccgtgtctcatccccagaacatgccgtctgtccaccggggagtggccttgatggccggcctcgaaggccacaaacaaggcgtcgaggaattggaaagatttgcacaccctccagaaaggagagacgcaatctcccctccctcccatcccccaccttcgctggaacagcttcctctcactgaacggagacgcccccttggacgaactgcctaatcgtttggttctgaggcctggtttgctcttaattaatatatgaactcctcagaccttaaaccttttcctaagctttctttactgcactggagttctgactccctttgagttgtgtgttactgggggtggggtggggtcatgggttttgttgtttttgggggctaattggtgcatattcaggtaccacctttgacgtgtggctctttctcctgaccatcatgggaagtgtctgctggattccattttctaagagtttctgagggtgaggctcttattttttttttaagggatcctgtctatttcctgcacttcgagaagaatcaaaatgttcctgaatttcaaatacctcatgcaaaatgtgtctcctgaaataagggaaaaaaaaaaaaaaccacaactttgaaaatcttaatgttgaagttagcaatgccgaaaggtttctgtcttaaaaaaaaaaaatccttgtacttatcaattttgccccttaggcagtcagttttgttgagaactgtgtcctgcatcctggcgcagaacctcctgatgcggttcctctccacgcatctcgaggcggcgttacctccagattccgtagagttagagtcacatttttctttgcagcgaaactccgtcttggtgagagatgaatttggatatttatttccttctctgtttttgggaaacgagaggctacaaccaagacagctgaaggagaatgaaacacacatccacagaaacagagaggcgtaggtggccctgccgttgaccgcagcctctctggacaggcaaggggagttggcgcaggtgaggactcagacgacgtccaccgtcccaaggctgtcactagtatttctctgaagtgcctgaaggtaggaatgggccggcgattgggaccagctgggccccaccacggccacgccaggcaaagcgccagcagccctgcactccacgctggccaagaaggccttccacgcagaatgacaagactgcaaaaatccgatgtgcttccttccctggcgcagtcgctcctcgagccgctgccccccacccaccctgcacccctcgccctcccccccaccacagaatctaagacctttcagcttcgagccagggggcgggggatcccgagcaaaagccttccatggacatcaggccccgtggcctcaagggctcccagggcaaacctaattcccccaaaacgtgaagtcggggaagctgcggctacacattccacaaagtgctggcacttacacccacaacccggaaggctgtggaccgattcctctagggtggtgacctcccattagcaaacggtgtcatggtttggaatgttcattatcgccaagaacctggttagaggcataaagaccttttttcaccgttacctaattttttcccctttcaagaattttttttttttttggtgtgttgtacagcagtataatttttcacttatttattcctacagtagatatggtttgtacaatgtacaattgtttcatttcagaaaataaaaatttcaaatcatg

SEQ ID NO: 71458 - DNA, 2929 bp, Homo sapiens
tttgtcctactgttcttttattcccacggttttacccctgctctttgttcgatattttgtatatcgtctttccttcattttgcgggtgtgccgtgctggtgtctttacccccctgtttgtcactcgactatttctgggtcatccgttctccatctcttttagttccccacgtgttcgccccgttgtgtcttataccctcttttttgttcgcggtctcttggttttttggtggtgccttgtgggtgttttgttcgttttttctttgcttttttcttgagacttccgtgttttgctctgttgcccaggctggagtgcaatggcatgatcattgcacctctgcctcccaggttcaagcattttcctgcctcagcctcccgcgtagctcagattacaggcctgcaccaccacgcccagctaatttttgtatttttagtagagacagggtttctccatgttggccaggctggtctcgaactcctgacctcgtgatctgcccacttcggcctccaaagtgctgggattacaggcatgaaccaccgcgcccggccttttttttttttctgagacagggtctcactctgtctcccaggctggagtgcagtggctggatctctgctcactgcaacctccgtctcccaggttcaagcgagtctcctgcctcagactcccgagtagctgcgattacaggagcccaccaccgcgcccggctaatttttgtatttttagtagagacggggtttcacccaccatgttggccaggctggtatcgaactcttaacctcaagtgatccacccgcctcggcctcccaaagtgctggtattacaggcatgagccaccgcgcccggccagtatttgttcttttcttcatttttcacgtcaggagactgcgtttcagaatagtaaaaacaaatgcctaggaaaaggcctgcggtctctccatttccacagtagcgtgttccccaaagaccaaaccctcaggggaaacgtctagaatgagtaacaacttaaggctgcaaccttaaactttcccaggactcagtttccccagctgtgaaatggctgctgtcgggctgtcatctccaggcccggggcgctgacatttgggccactctcggtctccctcttcattctgggcgcgcattagctctggtccggccggttccgctgcagctgaacagcaagatgcggcacccaggttaccctgatcatcgcagatttctccccggggctctgttctgaggcctcaaaagtgctccttgtagatgggaccaggggtcatttgggcagtagcagcgcctggtctcagtctggtactgaagtcaggaatggcttaaggtgaaatcgtggtcctctggtgaagctcagcgaagaccccctcgccttgtttatgacaagagaacttctgggggcgggaggaagagtccctgttacgatgctgatcatcattgagcttttgctgagaaaactctttagtactaaggtcgagagtctctgtggtctgcctggcaccagcaccttcctacaaccctagttttccaaaaggaaaagcctggggccaggcgacgtcctagctcgcattatgacagggccgcgggccaccagagatgcgcgatgcccaactctttccaagagcacctcgcgtcccgaaccggtgccttcaactcggagaagtcaagagacccgcaagaaacttgcacgactgcacccgccgccgcgctgctgggggctgggcaggggcagctgggctggctcccggggagacgcgacccccccgcgccccgcagaccggctgtctcccatggacccctcggcacctgcagctccgaggaagggtcagcgcgcgtgtccgcaccccgcccccaccgcgcgcccagagccgggggtcgccgtggcccttcgccacctccccaggagggcgtccggggcgtcccctctgggcgacgcgaggcccggggggctgcggtggccgcggcgcggagccgcactccggcggcggcggcggcgcggctccccctgctctgtgcagctgccgcccgggcttgcgctgggccaggcgcgcggcggccccgggctttgtgtgtgtgtatgtgtgtgtgtgtgtgtgtgtgtgtgtgtgagagtgtgtgcgtgtgagagtgcgagtgtctgtgcgcgagtgagtgagcggcgggcgggcgcgagtgtggccgccgcggagcgcgagcaggacccggcgggcgcgctccccagcctccgtctccccgccggaaccatgtcgggcaggtcggttcgagccgagacgaggagccgggccaaagatgatatcaagagggtcatggcggcgatcgagaaagtgcgcaaatgggagaagaaatgggtgaccgttggtgacacatccctacgaatctacaaatgggtccctgtgacggagcccaaggttgatgacaaaaacaagaataagaaaaaaggcaaggacgagaagtgtggctcagaggtgaccactccggagaacagttcctccccagggatgatggacatgcatgcaggtttgttcacattccaggcaaggggtaggagggctgggcagggcccggcggcctctgtgccaaggagaagagtcagcggaggagaggatgtttcttttcccagcgtaccaagccaagagacataaactaagccagagacatagaaattagaccctctcctcacccagggacaagaaccccgcaggagatgtttctctcagcctcgtgtgtccaggaagattgtttgggcgtatgtttcttcgccccctcatataaattatataaatggctgtgtttcccattttgctttggctgctgggaatctccaaactggattttgtttgtttgttttgttttgttttgtttttgagatggagttttgctctgttgaccagcctgggcaagagagtgaggccttgtctcc

SEQ ID NO: 71459 - DNA, 3586 bp, Homo sapiens
gagcgtctagaggatcccgctgctgactactactacccggtgctgcgctccccagcctccgtctccccgccggaaccatgtcgggcaggtcggttcgagccgagacgaggagccgggccaaagatgatatcaagagggtcatggcggcgatcgagaaagtgcgcaaatgggagaagaaatgggtgaccgttggtgacacatccctacgaatctacaaatgggtccctgtgacggagcccaaggttgatgacaaaaacaagaataagaaaaaaggcaaggacgagaagtgtggctcagaggtgaccactccggagaacagttcctccccagggatgatggacatgcatgacgataacagcaaccagagctccatcgcagatgcctcccccatcaaacaggagaacagcagcaactccagccccgctccagagcccaactcggctgtgcccagcgacggcaccgaggccaaggtggatgaggcccaggctgatgggaaggagcacccaggagctgaagatgcttctgatgagcagaattcacagtcctcgatggaacattcgatgaacagctcagagaaagtagatcggcagccgtctggagactcgggtctggccgcagagacgtctgcaatctctcaggatctggaaggagtgccaccctctaaaaagatgaaactggaggcctctcaacaaaactccgaagagatgtagacgatgctttaaagcctccgatccatgttccatggaaggtacatcagcaattaattctagagcaactttgccccagcgattcctcttgggtgcgaacagaactactaacgtttcaagtttaccaagtgcaaatccaagaagacccagaacggcgtcacttctcagacactgaagaactctgctgtgaagcaaaacactcaaacctttaagggactgtccttggggaggcaggcggggctgacagctcaggagtgtctgcacactgtctcggaagccaggattccatttgtgttgctgctgtattttccccccacttctctatgtaacgatataagctatcggagggtggtaccgatcaggaacgctttttggcggggctttccactgttcaaccgattccttccgctttctttttttgtgccttgtgcccttgaggtgacctctggcatgtatcctggtggttcttacatccccctctgcaaagtgccctcttggtttggttcgggcggcggctgccaccctactcaccgctctcctccctgccccaggacttcatcggagcaggcagggtggagcgaaggagctccttagcccacctggtttgcaggtgcagggggaccttaggcacgccccaagcaccaggcaccagggcccaaggacgcgcaggtgttggggcacagtccccaagggctcggccccttggatcaggctgggcactcgctgtgctctcccctccttggggcgtttaggactgggcgtctccaagcccaccatggcccagatggacgtgcaaagcccttggaattttctggcacttcctctctattgcccccaccaccaccacccccatcactgctttctcccagacctccgaatacgaaatggcttctctggctgactgcaaggctgtctccttaaggcactgagtgggccggggaggctgggagccggcggcaggattagctggtgctgaactttctctcataggacgtcgcttggatttcaaatccacggtcacctgctgccctttgcctcccccgacgccccagcctgtgccccggagaggcaggatcgcagtggtcagaatccacgtgctttcctattctcaggctgttctgactctgagccaacagctggaccgtgtctcatccccagaacatgccgtctgtccaccggggagtggccttgatggccggcctcgaaggccacaaacaaggcgtcgaggaattggaaagatttgcacaccctccagaaaggagagacgcaatctcccctccctcccatcccccaccttcgctggaacagcttcctctcactgaacggagacgcccccttggacgaactgcctaatcgtttggttctgaggcctggtttgctcttaattaatatatgaactcctcagaccttaaaccttttcctaagctttctttactgcactggagttctgactccctttgagttgtgtgttactgggggtggggtggggtcatgggttttgttgtttttgggggctaattggtgcatattcaggtaccacctttgacgtgtggctctttctcctgaccatcatgggaagtgtctgctggattccattttctaagagtttctgagggtgaggctcttattttttttttaagggatcctgtctatttcctgcacttcgagaagaatcaaaatgttcctgaatttcaaatacctcatgcaaaatgtgtctcctgaaataagggaaaaaaaaaaaaaaccacaactttgaaaatcttaatgttgaagttagcaatgccgaaaggtttctgtcttaaaaaaaaaaaatccttgtacttatcaattttgccccttaggcagtcagttttgttgagaactgtgtcctgcatcctggcgcagaacctcctgatgcggttcctctccacgcatctcgaggcggcgttacctccagattccgtagagttagagtcacatttttctttgcagcgaaactccgtcttggtgagagatgaatttggatatttatttccttctctgtttttgggaaacgagaggctacaaccaagacagctgaaggagaatgaaacacacatccacagaaacagagaggcgtaggtggccctgccgttgaccgcagcctctctggacaggcaaggggagttggcgcaggtgaggactcagacgacgtccaccgtcccaaggctgtcactagtatttctctgaagtgcctgaaggtaggaatgggccggcgattgggaccagctgggccccaccacggccacgccaggcaaagcgccagcagccctgcactccacgctggccaagaaggccttccacgcagaatgacaagactgcaaaaatccgatgtgcttccttccctggcgcagtcgctcctcgagccgctgccccccacccaccctgcacccctcgccctcccccccaccacagaatctaagacctttcagcttcgagccagggggcgggggatcccgagcaaaagccttccatggacatcaggccccgtggcctcaagggctcccagggcaaacctaattcccccaaaacgtgaagtcggggaagctgcggctacacattccacaaagtgctggcacttacacccacaacccggaaggctgtggaccgattcctctagggtggtgacctcccattagcaaacggtgtcatggtttggaatgttcattatcgccaagaacctggttagaggcataaagaccttttttcaccgttacctaattttttcccctttcaagaattttttttttttttggtgtgttgtacagcagtataatttttcacttatttattcctacagtagatatggtttgtacaatgtacaattgtttcatttcagaaaataaaaatttcaaatcatg

SEQ ID NO: 71460 - DNA, 3077 bp, Homo sapiens
ggagctgcggagctcggatttctcccccgtctggcccgctctcgacccgcgcgctctgctgggccatggagccggcccccgacgcccaggaggcgcgcactgtgcgcgaggcgctgggccgctacgaggcggcgctggagggtgcggtgcgcgcgctgcacgaggacatgcgggggctgcagcgcggcgtggagcggcgagtggcagaggcgatgcgcctggccggccccctggcgcgcacggtggccgacctgcagcgggacaaccagcggctgcaggcgcagctcgagcgcctgacgcgccaggtggaggcgctgggcttggccagcgggatgtccccggtgcccggcactcccggcacgcccagccccccgcccgcgcccggggttcccgaccgcgcgccccgcctgggcagcgcacgcttcgccagccacgccaccttctcgctgtccggccgcggccagagtttggatcacgatgaggccagtgagtcggagatgagaaagacctcaaactcctgcatcatggaaaatgggcaccagccgggggcagagaagaattcctctttcacgtggtctgtgccaagctctggctatggggcagtgacagcaagcaaacacagcaatagcccaccgctggtgacaccaccccagtcgcccgtgtccccgcagccgccagccataactcaggtccatcggcagggggagcgtcgcagggagctggtgaggtcgcagacgctgccccgcacctcggaggcgcaggcccggaaagcattgtttgagaagtgggagcaggaaacggcggccggcaaggggaaaggcgaggcccgggccaggctgaagcggtcgcagagcttcggcgtggccagcgccagcagcatcaagcagatcctgctcgagtggtgccgcagcaagacgctgggctaccagcacgtggacctgcagaacttctcctccagctggagcgacggcatggccttctgcgccctggtacactccttcttccccgatgcctttgactacaactccctgagccccacgcagaggcagaagaacttcgagctggctttcaccatggccgagaatctggccaactgtgagcgcctcatcgaagtggaggacatgatggtgatgggccgcaagccggaccccatgtgtgtcttcacctacgtccagtcgctgtacaaccacctgcgtcgcttcgagtaaagcccctgagcctggattgccaaagagcagccccaggaagaggccgggggtccgcttgcgattccccagccaggatgcccccaggagccttgccgtttggtgtgagcgcgctgtttgttctgtggcatgtgacggcactccccttcgagcccagctgtgttactgattaaaagtactgctgagctgtggtccgacagcactgatcacagccaagggcttggaggaaaaggaaaaattatgagagagagagagacattggtgctaagtaatgatcttcctaaagaaatgcttgtgtttatagcttccagaatgctaatctacaattttccctctggtgaattcgatacatcggctttacagggttacagtgattaccaagtgtttttttttatcaaaatacccagagttttttacttcctcacgcgattgtaggttcctctcctccctccctctgggccactgccaggaaacagagagaccgcttaatcagcagcttgacaaagaagacctcaagtcttgggaagaaacagtttaatcactcccaagtcctgggcaacagatgaccttcaagtcacctccgctctccggggagatgggaaggctctcctctcggtcccaaagtcctcctgttcttcccaggaggccccacaagtgtttggctaagcacaggctctcgggaatttaacacttttggggaaggaataggccctttgtgctgagagagagtttttattcacatcttttttaggggatttgctgcagatatttataaaaagtaactccctctgtaccactgacccatttatacataaaaaagatgtgttgaattttgcttggggtttgtcatttctgtttaggagatgggagttctgtgaataagagactttgcacaccttccaagtgaatatccactacattccacccctgttcctgcacttaaatcactggcctggaaagctgaagatggcatttgctgtcatctctgatcatctctgagtgtgcctgtctcccatctccatgttgtggaaggagcgtcaacagaaagttccccttgagatccgtcctctggatgtagaccgcagtgtttgtgataaacagtggcccaagacagcagggtttggggtggtcccgcacttggaggaagcccatcaaggaacgttggtttattttcacagctgtttggtggtaggactttcatagaaaaatcttgagattctatagagctccagccattagcttattctcagccaagaatcattgtataattgggttggattttagccatgcacttctaaaccttccctttaaggagcggatctgtgtcttcacctcatgcagccggctctcaacaccagtgcctgtgtgcctttgtggggtcccacgtgtcccttgggtggtatattgggggtgggcaggagatccctggggtgtcaggaggaacatgcagagcctgcaggtgggtgagcagtattctccatggattggttggtccaggctgcagtcttgccctctctctcggattctcccactctggaaaccattcccttgctagctctctcgtctcttgtacgcttggggaggtgagacctattattaacaggacacataactgaaggttagggtttcaaacctgaagccaatctgggaacacaagggctctgtaaaaagcatggctatatgttactgagtcctcgcacacgttaaatggagctctcccgagttgcagacatggccgtacctctgcgcatgaaacagagcagatcctgccagaatgcagaacaatttcttttaaactttaggaatggtgtccctcatgtctcacattcagaatgagacagactcgagtttttaaagttggttccatgatgt

SEQ ID NO: 71461 - DNA, 2034 bp, Homo sapiens
ggagctgcggagctcggatttctcccccgtctggcccgctctcgacccgcgcgctctgctgggccatggagccggcccccgacgcccaggaggcgcgcactgtgcgcgaggcgctgggccgctacgaggcggcgctggagggtgcggtgcgcgcgctgcacgaggacatgcgggggctgcagcgcggcgtggagcggcgagtggcagaggcgatgcgcctggccggccccctggcgcgcacggtggccgacctgcagcgggacaaccagcggctgcaggcgcagctcgagcgcctgacgcgccaggtggaggcgctgggcttggccagcgggatgtccccggtgcccggcactcccggcacgcccagccccccgcccgcgcccggggttcccgaccgcgcgccccgcctgggcagcgcacgcttcgccagccacgccaccttctcgctgtccggccgcggccagagtttggatcacgatgaggccagtgagtcggagatgagaaagacctcaaactcctgcatcatggaaaatgggcaccagccgggggcagagaagaattcctctttcacgtggtctgtgccaagctctggctatggggcagtgacagcaagcaaacacagcaatagcccaccgctggtgacaccaccccagtcgcccgtgtccccgcagccgccagccataactcaggtccatcggcagggggagcgtcgcagggagctggtgaggtcgcagacgctgccccgcacctcggaggcgcaggcccggaaagcattgtttgagaagtgggagcaggaaacggcggccggcaaggggaaaggcgaggcccgggccaggctgaagcggtcgcagagcttcggcgtggccagcgccagcagcatcaagcagatcctgctcgagtggtgccgcagcaagacgctgggctaccagcacgtggacctgcagaacttctcctccagctggagcgacggcatggccttctgcgccctggtacactccttcttccccgatgcctttgactacaactccctgagccccacgcagaggcagaagaacttcgagctggctttcaccatggccgagaatctggccaactgtgagcgcctcatcgaagtggaggacatgatggtgatgggccgcaagccggaccccatgtgtgtcttcacctacgtccagtcgctgtacaaccacctgcgtcgcttcgagtaaagcccctgagcctggattgccaaagagcagccccaggaagaggccgggggtccgcttgcgattccccagccaggatgcccccaggagccttgccgtttggtgtgagcgcgctgtttgttctgtggcatgtgacggcactccccttcgagcccagctgtgttactgattaaaagtactgctgagctgtggtccgacagcactgatcacagccaagggcttggaggaaaaggaaaaattatgagagagagagagacattggtgctaagtaatgatcttcctaaagaaatgcttgtgtttatagcttccagaatgctaatctacaattttccctctggtgaattcgatacatcggctttacagggttacagtgattaccaagtgtttttttttatcaaaatacccagagttttttacttcctcacgcgattgtaggttcctctcctccctccctctgggccactgccaggaaacagagagaccgcttaatcagcagcttgacaaagaagacctcaagtcttgggaagaaacagtttaatcactcccaagtcctgggcaacagatgaccttcaagtcacctccgctctccggggagatgggaaggctctcctctcggtcccaaagtcctcctgttcttcccaggaggccccacaagtgtttggctaagcacaggctctcgggaatttaacacttttggggaaggaataggccctttgtgctgagagagagtttttattcacatcttttttaggggatttgctgcagatatttataaaaagtaactccctctgtaccactgacccatttatacataaaaaagatgtgttga

SEQ ID NO: 71462 - DNA, 786 bp, Homo sapiens
ggagctgcggagctcggatttctcccccgtctggcccgctctcgacccgcgcgctctgctgggccatggagccggcccccgacgcccaggaggcgcgcactgtgcgcgaggcgctgggccgctacgaggcggcgctggagggtgcggtgcgcgcgctgcacgaggacatgcgggggctgcagcgcggcgtggagcggcgagtggcagaggcgatgcgcctggccggccccctggcgcgcacggtggccgacctgcagcgggacaaccagcggctgcaggcgcagctcgagcgcctgacgcgccaggtggaggcgctgggcttggccagcgggatgtccccggtgcccggcactcccggcacgcccagccccccgcccgcgcccggggttcccgaccgcgcgccccgcctgggcagcgcacgcttcgccagccacgccaccttctcgctgtccggccgcggccagagtttggatcacgatgaggccagtgagtcggagatgagaaagacctcaaactcctgcatcatggaaaatgggcaccagccgggggcaggtccaggcgatggaccccctgagattgcccaaaacttctcagcaccagatccccccaggcctcgtcctgtgagcctctccttgcggctgccccaccagccagtcacggccatcacccgagtctctgacaggttctctggggagacctcagctgcggctctatcacccatgtctgctgccaccctggggggcctcaacccaagccccagcgaggtcatcacgccctggactccca

SEQ ID NO: 71463 - DNA, 909 bp, Homo sapiens
ccgggtgtcaatcggccgagggtggctagtggtatcagttctctgatccacttccatttaagctccccaggaaatcccatgacaaactggcctctggctggcgcgctgattagacttcagttcctgaaaaggaccagtggagggaagagctatacttctggagaagtaggcctggagttactacagtatgggggaaaagggtcgagttagaacaaagctaaggcaattcctattgcttccttgcgcaacttctcaaaacgatgaaagtcagaaggctgtcaaactcaaatatctttgcaaacactgtttgaatactgtgaattcattacgaagaatgttcgagagaaagcaggggtctaatccaaaagaaatgtcattaaccaatactccaagtccttgagttttgttatatctgaactagttgaactgtgactgacaggtaatcctaatatatccaaatccaactgaataccaaattgagatggcaaatttttgtttgatataagttagcttgttagcatatgccctagagggcctccatccctgtattctaatgtttttactcaaagctctagcctttaggataggtgaatatgtaaatcttttatcactttctcaaattcaaactaaaggggaaagatcaaaccccttcccttcctacctgttttctgagctggctgacttgccagccacaagctgctcttgcagagttcttaccattcctgtaaatgttttgacttgttgcagaaattcctatctactttattaagcagtattgatctgactgtggaaacatcctctcacttgcattcttttaacttaaaactatttaagaactgatgttccgattattgtatatatttttctaaaaaccaaataaagctacctatgaaaatgaaaaaaaaaatc

SEQ ID NO: 71464 - DNA, 467 bp, Homo sapiens
  misc_feature (11)..(11): n is a, c, g, or t
ggatccccttntccacaggggttcctgaaaaggaccagtggagggaagagctatacttctggagaagtaggcctggagttactacagtatgggggaaaagggtcgagttagaacaaagctaaggcaattcctattgcttccttgcgcaacttctcaaaacgatgaaagtcagaaggctgtcaaactcaaatatctttgcaaacactgtttgaatactgtgaattcattacgaagaatgttcgagagaaagcaggggtctaatccaaaagaaatgtcattaaccaatactccaagtccttgagttttgttatatctgaactagttgaactgtgactgacaggtaatcctaatatatccaaatccaactgaataccaaattgagatggcaaatttttgtttgatataagttagcttgttagcatatgccctagagggcctccatcctgtggaaagtaggtaccggccac

SEQ ID NO: 71465 - DNA, 3707 bp, Homo sapiens
cattgaccttcaggtctgtcatcctgcttaagagtttccgtgctttgtctgcaagatggtgcttaaagctttacctaggagcagtatttgctgggttatgtcggtggaggacagcgtgctctgcctcgctggctactaagtgctggagctgcagcctgtcccctccaggtgcaatgtcacgtccccagatgcttaacttgtggtctaggggtaccttttaaaaatcgttgcaacactgcttacaattttcgccctccaagtggacagcttcgggcatccctcaccgccccagattctcaagggggtctggtgcccaccgttttatgtagcgtgagtttaattcccagggctcagatgtcaaggagacaagagctaccgctcagtgggcgttttctcaacccaaactcccgatcgacctcgagtctccccgccggacccggagcaaatctcagagtcaagatgcgagaaggggtggccgggcggcggacctcaggcttccggcacccttgcgcttcccgccggcacgaaggactcccctggacaaccgcccgcctctcagaggccggagtcctaggccctccggcctgcgttgcctgtccacagacgcgccggcctcgggacacccaccacaggggtaagacgcgcctctgccagctccccagcccgaaacccagaacgccctcctaggagcctcacagcgcagatcaggggacgggctttcggccgcaccccttcactctttccccgccttctttgtttattccggacccaccattggctgcttgccctcgataccgggcgagccgccggtctttggagagaggcgattggacgaagtccctgccgctcggccagcagcccgctcgcgattggttgaggcgccgccgggggtttgaatcgcatccccggccggggagggttctgccaaagtgccacgttgggcccggcggcggcgtgaagactggcggctgcgtgagactccggctccaggcgttcgcaccgtaatgcccggccgttggggccgtcggtaggcgcgaggcgagtcgaggcagccggccggtcggcggccgccggcgggaacggggctgaggcggcgcagcggagtctgggcggcggcgcgtcccgcccgagggcggctctggctgagggcggaggggccggggaagagcccggggcagcggctgaggcgggacggcggcgggggccgctgcccctagaagacccagccgagatgctggcggaaaacctggtagaggagtttgagatgaaggaggacgagccgtggtacgaccaccaggacctccagcaagatcttcaacttgctgctgagcttgggaagacattactggatcggaacacagagttggaggactctgttcagcagatgtatacaaccaatcaggagcagttacaggaaattgaggtaattcacttggcaggagagttacacttttgacacttcgatgtgttgctgttatgccaatcacatactgtatctgacgaagcaagtggaacttctacggcagatgaacgaacaacatgcaaaggtttatgaacaattagacgtcacagcaagggaactggaagaaacaaatcaaaagctagttgctgacagcaaggcctcacagcaaaagattctgagcctgactgaaacgattgaatgcctgcaaaccaacattgatcacctccagagccaagtggaggagctgaagtcatctggccaagggagaaggagcccgggaaagtgtgaccaggagaaaccggcacccagctttgcatgtctgaaggagctgtatgacctccgccaacacttcgtgtatgatcatgtgttcgctgagaagatcacttccttgcaaggtcagccaagccctgatgaagaggaaaatgagcacttgaaaaaaacagtgacaatgttgcaggcccagctgagcctggagcggcagaagcgggtgactatggaggaggaatatgggctcgtgttaaaggagaacagtgaactggagcagcagctgggggccacaggtgcctaccgagcacgggcgctggaactagaggccgaggtggcagagatgcgacagatgttgcagtcagagcatccatttgtgaatggagttgagaagctggtgccagactctctgtatgttcctttcaaagagcccagccagagcctgctggaagagatgttcctgactgtgccggaatcacatagaaagcctctcaagcgcagcagcagtgagacgatcctcagcagcttggcagggagtgacatcgtgaagggccacgaggagacctgcatcaggagggccaaggctgtgaaacagaggggcatctcccttctgcacgaagtggacacgcagtacagcgccctgaaggtgaagtatgaagagttgctgaagaagtgccaagaggaacaggactccctgtcacacaaggctgtgcagacctccagggctgcagccaaggacctgactggagtgaacgcccagtctgagcctgttgccagcggctgggaactggcctctgtcaacccagagcccgtgagttcccctacaacacctccagaatacaaagcgttgtttaaggagatctttagttgcatcaagaaaactaagcaggaaatagatgaacagagaacaaaataccgatcactctcctctcattcttaattgaacctctagctctactactaatttgcctattgcctatcgcctctctctcccattcagacaagtgtttgtagactctgaagcctaatgttactcatgacgtttgcctcattgctttgcttatttagcaaatgcatacaacgaggaaaggaggtggctagtggtatcagttctctgatccacttccatttaagctccccaggaaatcccatgacaaactggcctctggctggcgcgctgattagacttcagttcctgaaaaggaccagtggagggaagagctatacttctggagaagtaggcctggagttactacagtatgggggaaaagggtcgagttagaacaaagctaaggcaattcctattgcttccttgcgcaacttctcaaaacgatgaaagtcagaaggctgtcaaactcaaatatctttgcaaacactgtttgaatactgtgaattcattacgaagaatgttcgagagaaagcaggggtctaatccaaaagaaatgtcattaaccaatactccaagtccttgagttttgttatatctgaactagttgaactgtgactgacaggtaatcctaatatatccaaatccaactgaataccaaattgagatggcaaatttttgtttgatataagttagcttgttagcatatgccctagagggcctccatccctgtattctaatgtttttactcaaagctctagcctttaggataggtgaatatgtaaatcttttatcactttctcaaattcaaactaaaggggaaagatcaaaccccttcccttcctacctgttttctgagctggctgacttgccagccacaagctgctcttgcagagttcttaccattcctgtaaatgttttgacttgttgcagaaattcctatctactttattaagcagtattgatctgactgtggaaacatcctctcacttgcattcttttaacttaaaactatttaagaactgatgttccgattattgtatatatttttctaaaaaccaaataaagctacctatgaaaatgaaaaaaaaaatc

SEQ ID NO: 71466 - DNA, 810 bp, Homo sapiens
  misc_feature (11)..(11): n is a, c, g, or t
ggatccccttntccacaggggttcctgaaaaggaccagtggagggaagagctatacttctggagaagtaggcctggagttactacagtatgggggaaaagggtcgagttagaacaaagctaaggcaattcctattgcttccttgcgcaacttctcaaaacgatgaaagtcagaaggctgtcaaactcaaatatctttgcaaacactgtttgaatactgtgaattcattacgaagaatgttcgagagaaagcaggggtctaatccaaaagaaatgtcattaaccaatactccaagtccttgagttttgttatatctgaactagttgaactgtgactgacaggtaatcctaatatatccaaatccaactgaataccaaattgagatggcaaatttttgtttgatataagttagcttgttagcatatgccctagagggcctccatccctgtattctaatgtttttactcaaagctctagcctttaggataggtgaatatgtaaatcttttatcactttctcaaattcaaactaaaggggaaagatcaaaccccttcccttcctacctgttttctgagctggctgacttgccagccacaagctgctcttgcagagttcttaccattcctgtaaatgttttgacttgttgcagaaattcctatctactttattaagcagtattgatctgactgtggaaacatcctctcacttgcattcttttaacttaaaactatttaagaactgatgttccgattattgtatatatttttctaaaaaccaaataaagctacctatgaaaatgaaaaaaaaaatc

SEQ ID NO: 71467 - DNA, 2970 bp, Homo sapiens
cattgaccttcaggtctgtcatcctgcttaagagtttccgtgctttgtctgcaagatggtgcttaaagctttacctaggagcagtatttgctgggttatgtcggtggaggacagcgtgctctgcctcgctggctactaagtgctggagctgcagcctgtcccctccaggtgcaatgtcacgtccccagatgcttaacttgtggtctaggggtaccttttaaaaatcgttgcaacactgcttacaattttcgccctccaagtggacagcttcgggcatccctcaccgccccagattctcaagggggtctggtgcccaccgttttatgtagcgtgagtttaattcccagggctcagatgtcaaggagacaagagctaccgctcagtgggcgttttctcaacccaaactcccgatcgacctcgagtctccccgccggacccggagcaaatctcagagtcaagatgcgagaaggggtggccgggcggcggacctcaggcttccggcacccttgcgcttcccgccggcacgaaggactcccctggacaaccgcccgcctctcagaggccggagtcctaggccctccggcctgcgttgcctgtccacagacgcgccggcctcgggacacccaccacaggggtaagacgcgcctctgccagctccccagcccgaaacccagaacgccctcctaggagcctcacagcgcagatcaggggacgggctttcggccgcaccccttcactctttccccgccttctttgtttattccggacccaccattggctgcttgccctcgataccgggcgagccgccggtctttggagagaggcgattggacgaagtccctgccgctcggccagcagcccgctcgcgattggttgaggcgccgccgggggtttgaatcgcatccccggccggggagggttctgccaaagtgccacgttgggcccggcggcggcgtgaagactggcggctgcgtgagactccggctccaggcgttcgcaccgtaatgcccggccgttggggccgtcggtaggcgcgaggcgagtcgaggcagccggccggtcggcggccgccggcgggaacggggctgaggcggcgcagcggagtctgggcggcggcgcgtcccgcccgagggcggctctggctgagggcggaggggccggggaagagcccggggcagcggctgaggcgggacggcggcgggggccgctgcccctagaagacccagccgagatgctggcggaaaacctggtagaggagtttgagatgaaggaggacgagccgtggtacgaccaccaggacctccagcaagatcttcaacttgctgctgagcttgggaagacattactggatcggaacacagagttggaggactctgttcagcagatgtatacaaccaatcaggagcagttacaggaaattgagtatctgacgaagcaagtggaacttctacggcagatgaacgaacaacatgcaaaggtttatgaacaattagacgtcacagcaagggaactggaagaaacaaatcaaaagctagttgctgacagcaaggcctcacagcaaaagattctgagcctgactgaaacgattgaatgcctgcaaaccaacattgatcacctccagagccaagtggaggagctgaagtcatctggccaagggagaaggagcccgggaaagtgtgaccaggagaaaccggcacccagctttgcatgtctgaaggagctgtatgacctccgccagtaagagcctgcctttctgtggagttacagcagggactgtctcatgtcattggcacattctgatttccagtagattgaaagtaccattttaagaaaagtcacttagctattaagctaccatggtttgaacaaaatcacttaaacatataaattacagagttcttagatattagtagttctcattttgaaagtcttggaacacttatttcagtgtttttaatgtattaaatcatagtttaagatgaattctgatagactagatttgggagttgtgttttacattagagtgaagaaaaacagaaatactggtaaaacaaaaattcaagcgaacaggagattttttgcttaaagaagtacctttataatttagagttataagtctgaatctttaagaagtatttatggaacacttgtgtggcaagctgtatgctagacccaagggttggcgagcaaaatagtttctacccctgtgagctttcagtctaacggaacggcagataagcaaataaaaacacaaataaatagtcaaggtgcttcagactgagcaggagaaaccaggtggttcatttggtgggtctcaaccttggctgtacatcagatcacctgtggggtttttcaaaatgcaaataccaacacatttcctcaggcctaaatcagaatttctaggtgcgggtaaaaagctgcccaggcaattctgatgaacattcctggttaaaaatcaccacagcaacagtaatttgctgtagtgattcaatcgtagttacatattatgaatcatttggagagcctttagaaaccctcaggccaggtagcagaccaactaggttggaatctgtgggttgggacccaggcaccagtactttttaaggtttcccttgtgaggtcattgtcatactgctagaatagatgttctctagtacttttaacattaaaaaaagatttgtcacaaaaattgagtttgctttcatgtgtttatttaccagcctcacacaattccattttagccactgctccaagtgtggctaaaaaccaatcaccacacccagcaaatttttgtatttttagtagagacggggttttgccatgttggccgggctggtctcgaactcctgacctcaagtgatctgcccacctcggcctcccagggtgctgggattacagccatgagccacagcacctgccaaagtggtcttaaaaggcttctgaagaggttatgtttgaaatgtcgccgat

SEQ ID NO: 71468 - DNA, 3637 bp, Homo sapiens
cattgaccttcaggtctgtcatcctgcttaagagtttccgtgctttgtctgcaagatggtgcttaaagctttacctaggagcagtatttgctgggttatgtcggtggaggacagcgtgctctgcctcgctggctactaagtgctggagctgcagcctgtcccctccaggtgcaatgtcacgtccccagatgcttaacttgtggtctaggggtaccttttaaaaatcgttgcaacactgcttacaattttcgccctccaagtggacagcttcgggcatccctcaccgccccagattctcaagggggtctggtgcccaccgttttatgtagcgtgagtttaattcccagggctcagatgtcaaggagacaagagctaccgctcagtgggcgttttctcaacccaaactcccgatcgacctcgagtctccccgccggacccggagcaaatctcagagtcaagatgcgagaaggggtggccgggcggcggacctcaggcttccggcacccttgcgcttcccgccggcacgaaggactcccctggacaaccgcccgcctctcagaggccggagtcctaggccctccggcctgcgttgcctgtccacagacgcgccggcctcgggacacccaccacaggggtaagacgcgcctctgccagctccccagcccgaaacccagaacgccctcctaggagcctcacagcgcagatcaggggacgggctttcggccgcaccccttcactctttccccgccttctttgtttattccggacccaccattggctgcttgccctcgataccgggcgagccgccggtctttggagagaggcgattggacgaagtccctgccgctcggccagcagcccgctcgcgattggttgaggcgccgccgggggtttgaatcgcatccccggccggggagggttctgccaaagtgccacgttgggcccggcggcggcgtgaagactggcggctgcgtgagactccggctccaggcgttcgcaccgtaatgcccggccgttggggccgtcggtaggcgcgaggcgagtcgaggcagccggccggtcggcggccgccggcgggaacggggctgaggcggcgcagcggagtctgggcggcggcgcgtcccgcccgagggcggctctggctgagggcggaggggccggggaagagcccggggcagcggctgaggcgggacggcggcgggggccgctgcccctagaagacccagccgagatgctggcggaaaacctggtagaggagtttgagatgaaggaggacgagccgtggtacgaccaccaggacctccagcaagatcttcaacttgctgctgagcttgggaagacattactggatcggaacacagagttggaggactctgttcagcagatgtatacaaccaatcaggagcagttacaggaaattgagtatctgacgaagcaagtggaacttctacggcagatgaacgaacaacatgcaaaggtttatgaacaattagacgtcacagcaagggaactggaagaaacaaatcaaaagctagttgctgacagcaaggcctcacagcaaaagattctgagcctgactgaaacgattgaatgcctgcaaaccaacattgatcacctccagagccaagtggaggagctgaagtcatctggccaagggagaaggagcccgggaaagtgtgaccaggagaaaccggcacccagctttgcatgtctgaaggagctgtatgacctccgccaacacttcgtgtatgatcatgtgttcgctgagaagatcacttccttgcaaggtcagccaagccctgatgaagaggaaaatgagcacttgaaaaaaacagtgacaatgttgcaggcccagctgagcctggagcggcagaagcgggtgactatggaggaggaatatgggctcgtgttaaaggagaacagtgaactggagcagcagctgggggccacaggtgcctaccgagcacgggcgctggaactagaggccgaggtggcagagatgcgacagatgttgcagtcagagcatccatttgtgaatggagttgagaagctggtgccagactctctgtatgttcctttcaaagagcccagccagagcctgctggaagagatgttcctgactgtgccggaatcacatagaaagcctctcaagcgcagcagcagtgagacgatcctcagcagcttggcagggagtgacatcgtgaagggccacgaggagacctgcatcaggagggccaaggctgtgaaacagaggggcatctcccttctgcacgaagtggacacgcagtacagcgccctgaaggtgaagtatgaagagttgctgaagaagtgccaagaggaacaggactccctgtcacacaaggctgtgcagacctccagggctgcagccaaggacctgactggagtgaacgcccagtctgagcctgttgccagcggctgggaactggcctctgtcaacccagagcccgtgagttcccctacaacacctccagaatacaaagcgttgtttaaggagatctttagttgcatcaagaaaactaagcaggaaatagatgaacagagaacaaaataccgatcactctcctctcattcttaattgaacctctagctctactactaatttgcctattgcctatcgcctctctctcccattcagacaagtgtttgtagactctgaagcctaatgttactcatgacgtttgcctcattgctttgcttatttagcaaatgcatacaacgaggaaaggaggtggctagtggtatcagttctctgatccacttccatttaagctccccaggaaatcccatgacaaactggcctctggctggcgcgctgattagacttcagttcctgaaaaggaccagtggagggaagagctatacttctggagaagtaggcctggagttactacagtatgggggaaaagggtcgagttagaacaaagctaaggcaattcctattgcttccttgcgcaacttctcaaaacgatgaaagtcagaaggctgtcaaactcaaatatctttgcaaacactgtttgaatactgtgaattcattacgaagaatgttcgagagaaagcaggggtctaatccaaaagaaatgtcattaaccaatactccaagtccttgagttttgttatatctgaactagttgaactgtgactgacaggtaatcctaatatatccaaatccaactgaataccaaattgagatggcaaatttttgtttgatataagttagcttgttagcatatgccctagagggcctccatccctgtattctaatgtttttactcaaagctctagcctttaggataggtgaatatgtaaatcttttatcactttctcaaattcaaactaaaggggaaagatcaaaccccttcccttcctacctgttttctgagctggctgacttgccagccacaagctgctcttgcagagttcttaccattcctgtaaatgttttgacttgttgcagaaattcctatctactttattaagcagtattgatctgactgtggaaacatcctctcacttgcattcttttaacttaaaactatttaagaactgatgttccgattattgtatatatttttctaaaaaccaaataaagctacctatgaaaatgaaaaaaaaaatc

SEQ ID NO: 71469 - DNA, 3524 bp, Homo sapiens
cattgaccttcaggtctgtcatcctgcttaagagtttccgtgctttgtctgcaagatggtgcttaaagctttacctaggagcagtatttgctgggttatgtcggtggaggacagcgtgctctgcctcgctggctactaagtgctggagctgcagcctgtcccctccaggtgcaatgtcacgtccccagatgcttaacttgtggtctaggggtaccttttaaaaatcgttgcaacactgcttacaattttcgccctccaagtggacagcttcgggcatccctcaccgccccagattctcaagggggtctggtgcccaccgttttatgtagcgtgagtttaattcccagggctcagatgtcaaggagacaagagctaccgctcagtgggcgttttctcaacccaaactcccgatcgacctcgagtctccccgccggacccggagcaaatctcagagtcaagatgcgagaaggggtggccgggcggcggacctcaggcttccggcacccttgcgcttcccgccggcacgaaggactcccctggacaaccgcccgcctctcagaggccggagtcctaggccctccggcctgcgttgcctgtccacagacgcgccggcctcgggacacccaccacaggggtaagacgcgcctctgccagctccccagcccgaaacccagaacgccctcctaggagcctcacagcgcagatcaggggacgggctttcggccgcaccccttcactctttccccgccttctttgtttattccggacccaccattggctgcttgccctcgataccgggcgagccgccggtctttggagagaggcgattggacgaagtccctgccgctcggccagcagcccgctcgcgattggttgaggcgccgccgggggtttgaatcgcatccccggccggggagggttctgccaaagtgccacgttgggcccggcggcggcgtgaagactggcggctgcgtgagactccggctccaggcgttcgcaccgtaatgcccggccgttggggccgtcggtaggcgcgaggcgagtcgaggcagccggccggtcggcggccgccggcgggaacggggctgaggcggcgcagcggagtctgggcggcggcgcgtcccgcccgagggcggctctggctgagggcggaggggccggggaagagcccggggcagcggctgaggcgggacggcggcgggggccgctgcccctagaagacccagccgagatgctggcggaaaacctggtagaggagtttgagatgaaggaggacgagccgtggtacgaccaccaggacctccagcaagtatctgacgaagcaagtggaacttctacggcagatgaacgaacaacatgcaaaggtttatgaacaattagacgtcacagcaagggaactggaagaaacaaatcaaaagctagttgctgacagcaaggcctcacagcaaaagattctgagcctgactgaaacgattgaatgcctgcaaaccaacattgatcacctccagagccaagtggaggagctgaagtcatctggccaagggagaaggagcccgggaaagtgtgaccaggagaaaccggcacccagctttgcatgtctgaaggagctgtatgacctccgccaacacttcgtgtatgatcatgtgttcgctgagaagatcacttccttgcaaggtcagccaagccctgatgaagaggaaaatgagcacttgaaaaaaacagtgacaatgttgcaggcccagctgagcctggagcggcagaagcgggtgactatggaggaggaatatgggctcgtgttaaaggagaacagtgaactggagcagcagctgggggccacaggtgcctaccgagcacgggcgctggaactagaggccgaggtggcagagatgcgacagatgttgcagtcagagcatccatttgtgaatggagttgagaagctggtgccagactctctgtatgttcctttcaaagagcccagccagagcctgctggaagagatgttcctgactgtgccggaatcacatagaaagcctctcaagcgcagcagcagtgagacgatcctcagcagcttggcagggagtgacatcgtgaagggccacgaggagacctgcatcaggagggccaaggctgtgaaacagaggggcatctcccttctgcacgaagtggacacgcagtacagcgccctgaaggtgaagtatgaagagttgctgaagaagtgccaagaggaacaggactccctgtcacacaaggctgtgcagacctccagggctgcagccaaggacctgactggagtgaacgcccagtctgagcctgttgccagcggctgggaactggcctctgtcaacccagagcccgtgagttcccctacaacacctccagaatacaaagcgttgtttaaggagatctttagttgcatcaagaaaactaagcaggaaatagatgaacagagaacaaaataccgatcactctcctctcattcttaattgaacctctagctctactactaatttgcctattgcctatcgcctctctctcccattcagacaagtgtttgtagactctgaagcctaatgttactcatgacgtttgcctcattgctttgcttatttagcaaatgcatacaacgaggaaaggaggtggctagtggtatcagttctctgatccacttccatttaagctccccaggaaatcccatgacaaactggcctctggctggcgcgctgattagacttcagttcctgaaaaggaccagtggagggaagagctatacttctggagaagtaggcctggagttactacagtatgggggaaaagggtcgagttagaacaaagctaaggcaattcctattgcttccttgcgcaacttctcaaaacgatgaaagtcagaaggctgtcaaactcaaatatctttgcaaacactgtttgaatactgtgaattcattacgaagaatgttcgagagaaagcaggggtctaatccaaaagaaatgtcattaaccaatactccaagtccttgagttttgttatatctgaactagttgaactgtgactgacaggtaatcctaatatatccaaatccaactgaataccaaattgagatggcaaatttttgtttgatataagttagcttgttagcatatgccctagagggcctccatccctgtattctaatgtttttactcaaagctctagcctttaggataggtgaatatgtaaatcttttatcactttctcaaattcaaactaaaggggaaagatcaaaccccttcccttcctacctgttttctgagctggctgacttgccagccacaagctgctcttgcagagttcttaccattcctgtaaatgttttgacttgttgcagaaattcctatctactttattaagcagtattgatctgactgtggaaacatcctctcacttgcattcttttaacttaaaactatttaagaactgatgttccgattattgtatatatttttctaaaaaccaaataaagctacctatgaaaatgaaaaaaaaaatc

SEQ ID NO: 71470 - DNA, 2784 bp, Homo sapiens
cattgaccttcaggtctgtcatcctgcttaagagtttccgtgctttgtctgcaagatggtgcttaaagctttacctaggagcagtatttgctgggttatgtcggtggaggacagcgtgctctgcctcgctggctactaagtgctggagctgcagcctgtcccctccaggtgcaatgtcacgtccccagatgcttaacttgtggtctaggggtaccttttaaaaatcgttgcaacactgcttacaattttcgccctccaagtggacagcttcgggcatccctcaccgccccagattctcaagggggtctggtgcccaccgttttatgtagcgtgagtttaattcccagggctcagatgtcaaggagacaagagctaccgctcagtgggcgttttctcaacccaaactcccgatcgacctcgagtctccccgccggacccggagcaaatctcagagtcaagatgcgagaaggggtggccgggcggcggacctcaggcttccggcacccttgcgcttcccgccggcacgaaggactcccctggacaaccgcccgcctctcagaggccggagtcctaggccctccggcctgcgttgcctgtccacagacgcgccggcctcgggacacccaccacaggggtaagacgcgcctctgccagctccccagcccgaaacccagaacgccctcctaggagcctcacagcgcagatcaggggacgggctttcggccgcaccccttcactctttccccgccttctttgtttattccggacccaccattggctgcttgccctcgataccgggcgagccgccggtctttggagagaggcgattggacgaagtccctgccgctcggccagcagcccgctcgcgattggttgaggcgccgccgggggtttgaatcgcatccccggccggggagggttctgccaaagtgccacgttgggcccggcggcggcgtgaagactggcggctgcgtgagactccggctccaggcgttcgcaccgtaatgcccggccgttggggccgtcggtaggcgcgaggcgagtcgaggcagccggccggtcggcggccgccggcgggaacggggctgaggcggcgcagcggagtctgggcggcggcgcgtcccgcccgagggcggctctggctgagggcggaggggccggggaagagcccggggcagcggctgaggcgggacggcggcgggggccgctgcccctagaagacccagccgagatgctggcggaaaacctggtagaggagtttgagatgaaggaggacgagccgtggtacgaccaccaggacctccagcaagtgagacgatcctcagcagcttggcagggagtgacatcgtgaagggccacgaggagacctgcatcaggagggccaaggctgtgaaacagaggggcatctcccttctgcacgaagtggacacgcagtacagcgccctgaaggtgaagtatgaagagttgctgaagaagtgccaagaggaacaggactccctgtcacacaaggctgtgcagacctccagggctgcagccaaggacctgactggagtgaacgcccagtctgagcctgttgccagcggctgggaactggcctctgtcaacccagagcccgtgagttcccctacaacacctccagaatacaaagcgttgtttaaggagatctttagttgcatcaagaaaactaagcaggaaatagatgaacagagaacaaaataccgatcactctcctctcattcttaattgaacctctagctctactactaatttgcctattgcctatcgcctctctctcccattcagacaagtgtttgtagactctgaagcctaatgttactcatgacgtttgcctcattgctttgcttatttagcaaatgcatacaacgaggaaaggaggtggctagtggtatcagttctctgatccacttccatttaagctccccaggaaatcccatgacaaactggcctctggctggcgcgctgattagacttcagttcctgaaaaggaccagtggagggaagagctatacttctggagaagtaggcctggagttactacagtatgggggaaaagggtcgagttagaacaaagctaaggcaattcctattgcttccttgcgcaacttctcaaaacgatgaaagtcagaaggctgtcaaactcaaatatctttgcaaacactgtttgaatactgtgaattcattacgaagaatgttcgagagaaagcaggggtctaatccaaaagaaatgtcattaaccaatactccaagtccttgagttttgttatatctgaactagttgaactgtgactgacaggtaatcctaatatatccaaatccaactgaataccaaattgagatggcaaatttttgtttgatataagttagcttgttagcatatgccctagagggcctccatccctgtattctaatgtttttactcaaagctctagcctttaggataggtgaatatgtaaatcttttatcactttctcaaattcaaactaaaggggaaagatcaaaccccttcccttcctacctgttttctgagctggctgacttgccagccacaagctgctcttgcagagttcttaccattcctgtaaatgttttgacttgttgcagaaattcctatctactttattaagcagtattgatctgactgtggaaacatcctctcacttgcattcttttaacttaaaactatttaagaactgatgttccgattattgtatatatttttctaaaaaccaaataaagctacctatgaaaatgaaaaaaaaaatc

SEQ ID NO: 71471 - DNA, 621 bp, Homo sapiens
  misc_feature (68)..(68): n is a, c, g, or t
gattcctgccactcgcaccactctcttgacaggaatcatgtaatctcgaagaaccaagtcatttacangattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatg

SEQ ID NO: 71472 - DNA, 404 bp, Homo sapiens
  misc_feature (14)..(14): n is a, c, g, or t
  misc_feature (36)..(36): n is a, c, g, or t
ccaattttaaaacngtccttaaagcaagtattattntctatttgtagtacctaagttataaaatttcactgaggctagaaatgtgaagactggtcacctttgaaggacggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaaaagtcggcagcctggaagaaagacaatcacaacctaattgagcgtcgcaggcgattcaacattaacgacaggatcaaggaactgggcactctcatccctaagtccagtgacccggagatgcgctggaacaagggcaccat

SEQ ID NO: 71473 - DNA, 2663 bp, Homo sapiens
atgcatttctcagaacttatccctgttgttcaatgatgtgtgtctatacagtggggccataactaagacgtatgttgcccaagctggcaagatagctctgaccttctcttgggcccctcatttcccccaaacacaggttgtctgcagtcttgaccaatggctgccagggcatggactccgctgcaggggccagtgggaggccccagctcaggcaaaagcacaggcagatatttcaggagtctgctagggctggcactgaggggcagagacagaggggtctccctgtcctttggagaacctcacgctgcagaaattccagactgaaccttcataccgagtaggggaggagctgtctgcgggtttgagcctgcagcaggaggaaggacgtgaacattttatcagcttctggtatggccttgagctggtagttataatcttggccctggtggcccagggctacagtcatcctagcagtccccgctgaagtggagcaggtacagtcacagctgtggggacagcatgctggccaagggtcttcccccacgctcagtcctggtcaaaggctgccagacctttctgagtgcccccagggaggggctggggcgtctcagggtgcccactggcgagggagctggcatctccacccgcagtcctcgccccttcaatgagatcccctctcctggtgacaatggctggctaaacctgtaccatttctggagggagacgggcacacacaaagtccaccttcaccatgtccagaatttccagaagtatggcccgatttacagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatgaaaaaaaaatgaaaaaaaaaaaaaaaaaaaaaaaagacaaaaaaaagaacaaccacagacaacagagcacaaaaaaaaagacgaaaaagaagacaacaacaggggggagggcaaaaagaaaacactcccgcacaggaggggcacaccctaagggacgaccacccgctattttaaatcaaccacatcgcggcgtcccctccatacaaacagcacgcgacattacattaaaaaccacacggcaccaccgccgcccgctcattaccatcacaccagcgcgcagacacactatgcacaaactacatctgcccacagtgccacaagcattgtgtcgagcacgaaccacacccagcctatacgcggcgggagcc

SEQ ID NO: 71474 - DNA, 2763 bp, Homo sapiens
atgcatttctcagaacttatccctgttgttcaatgatgtgtgtctatacagtggggccataactaagacgtatgttgcccaagctggcaagatagctctgaccttctcttgggcccctcatttcccccaaacacaggttgtctgcagtcttgaccaatggctgccagggcatggactccgctgcaggggccagtgggaggccccagctcaggcaaaagcacaggcagatatttcaggagtctgctagggctggcactgaggggcagagacagaggggtctccctgtcctttggagaacctcacgctgcagaaattccagactgaaccttcataccgagtaggggaggagctgtctgcgggtttgagcctgcagcaggaggaaggacgtgaacattttatcagcttctggtatggccttgagctggtagttataatcttggccctggtggcccagggctacagtcatcctagcagtccccgctgaagtggagcaggtacagtcacagctgtggggacagcatgctggccaagggtcttcccccacgctcagtcctggtcaaaggctgccagacctttctgagtgcccccagggaggggctggggcgtctcagggtgcccactggcgagggagctggcatctccacccgcagtcctcgccccttcaatgagatcccctctcctggtgacaatggctggctaaacctgtaccatttctggagggagacgggcacacacaaagtccaccttcaccatgtccagaatttccagaagtatggcccgatttacagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaaggtaggtgcagccagcaggctgcaggctctgccagtcagagagggctggggcaggctggaattgcagacagagggtggcactggggccctggtggggcccttgatggcagcagtctaagtctgaatgaagggcagaggtggtgggcatggtgggcggtgacctctaggatgttattggaacccagggttaggagggagacttcatgatttgcctgggtctgaggaaagggtgggacaatcatcctggccttgggtcttcagccatccccatttggtgggtaaggattacagaggggcggggccttgttcaaggctgcacagtgggcagaatgtcctgccctggagagctgggcagccatgctggggagtgggagtggtggtgagagggcaggggactagggaagggggttttgtgctcagggctgtggggaagtggggcttactcaggcctctgatcaccttgccccagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatg

SEQ ID NO: 71475 - DNA, 1847 bp, Homo sapiens
gatttcccgggctgcacgaattcggcacgagcctgaagtggagcaggtacagtcacagctgtggggacagcatgctggccaagggtcttcccccacgctcagtcctggtcaaaggctgccagacctttctgagtgcccccagggaggggctggggcgtctcagggtgcccactggcgagggagctggcatctccacccgcagtcctcgccccttcaatgagatcccctctcctggtgacaatggctggctaaacctgtaccatttctggagggagacgggcacacacaaagtccaccttcaccatgtccagaatttccagaagtatggcccgatttacagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatg

SEQ ID NO: 71476 - DNA, 2226 bp, Homo sapiens
atgcatttctcagaacttatccctgttgttcaatgatgtgtgtctatacagtggggccataactaagacgtatgttgcccaagctggcaagatagctctgaccttctcttgggcccctcatttcccccaaacacaggttgtctgcagtcttgaccaatggctgccagggcatggactccgctgcaggggccagtgggaggccccagctcaggcaaaagcacaggcagatatttcaggagtctgctagggctggcactgaggggcagagacagaggggtctccctgtcctttggagaacctcacgctgcagaaattccagactgaaccttcataccgagtaggggaggagctgtctgcgggtttgagcctgcagcaggaggaaggacgtgaacattttatcagcttctggtatggccttgagctggtagttataatcttggccctggtggcccagggctacagtcatcctagcagtccccgctgaagtggagcaggtacagtcacagctgtggggacagcatgctggccaagggtcttcccccacgctcagtcctggtcaaaggctgccagacctttctgagtgcccccagggaggggctggggcgtctcagggtgcccactggcgagggagctggcatctccacccgcagtcctcgccccttcaatgagatcccctctcctggtgacaatggctggctaaacctgtaccatttctggagggagacgggcacacacaaagtccaccttcaccatgtccagaatttccagaagtatggcccgatttacagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatg

SEQ ID NO: 71477 - DNA, 2238 bp, Homo sapiens
atgcatttctcagaacttatccctgttgttcaatgatgtgtgtctatacagtggggccataactaagacgtatgttgcccaagctggcaagatagctctgaccttctcttgggcccctcatttcccccaaacacaggttgtctgcagtcttgaccaatggctgccagggcatggactccgctgcaggggccagtgggaggccccagctcaggcaaaagcacaggcagatatttcaggagtctgctagggctggcactgaggggcagagacagaggggtctccctgtcctttggagaacctcacgctgcagaaattccagactgaaccttcataccgagtaggggaggagctgtctgcgggtttgagcctgcagcaggaggaaggacgtgaacattttatcagcttctggtatggccttgagctggtagttataatcttggccctggtggcccagggctacagtcatcctagcagtccccgctgaagtggagcaggtacagtcacagctgtggggacagcatgctggccaagggtcttcccccacgctcagtcctggtcaaaggctgccagacctttctgagtgcccccagggaggggctggggcgtctcagggtgcccactggcgagggagctggcatctccacccgcagtcctcgccccttcaatgagatcccctctcctggtgacaatggctggctaaacctgtaccatttctggagggagacgggcacacacaaagtccaccttcaccatgtccagaatttccagaagtatggcccgatttacagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatg

SEQ ID NO: 71478 - DNA, 2240 bp, Homo sapiens
ccgggcatggtggcgggggtctataatcccagctactcgggaggctgaggcaggacactcgcccgaacccaggaggtgggaggttgcagtgagccgagatcatgtcactgcactcccgccctgggcaacaaaagcgaaactctgtctcaaaaaaaaaaaaaaaaaaaaaatcgggggagggagatttgaaggtcagagcacagagtgaaaaggtcgcagcgtggtcaagtttggcgctagcgacagacccagcattcctcccagcgcacgccgccgcccgggccgcgctattccgaaattgggtccgccctagcgtggcccccggcctgctcctgcgctcttcgcgggtcgctcacctccgcctcccctcgacacagcccgagcccatccgccccccgggtcgacccgcgtttacctcagggcgaggtccaggcgctcggccccgcggaggcggcggcggccccaccgcaggttcctaggtcccagtcactctgccgccaagttccccaacacggactccgtgcgctttgaggtgttacgggggcgctggagcactggcttcgctggccctgccaggaggcggcggcgaagcagggagcgacccggtatgcgtttctctgcccggcctgcggccctgcagcatccactcctcgcctctgctggcctctgccctcgctcgctgcgttcacccgagctcacccgagcccaccggagccgacagtggcgcgctaagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatg

SEQ ID NO: 71479 - DNA, 1543 bp, Homo sapiens
tcggcacgaggatgggtcagtcacttagagggaaggggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatg

SEQ ID NO: 71480 - DNA, 2139 bp, Homo sapiens
atgcatttctcagaacttatccctgttgttcaatgatgtgtgtctatacagtggggccataactaagacgtatgttgcccaagctggcaagatagctctgaccttctcttgggcccctcatttcccccaaacacaggttgtctgcagtcttgaccaatggctgccagggcatggactccgctgcaggggccagtgggaggccccagctcaggcaaaagcacaggcagatatttcaggagtctgctagggctggcactgaggggcagagacagaggggtctccctgtcctttggagaacctcacgctgcagaaattccagactgaaccttcataccgagtaggggaggagctgtctgcgggtttgagcctgcagcaggaggaaggacgtgaacattttatcagcttctggtatggccttgagctggtagttataatcttggccctggtggcccagggctacagtcatcctagcagtccccgctgaagtggagcaggtacagtcacagctgtggggacagcatgctggccaagggtcttcccccacgctcagtcctggtcaaaggctgccagacctttctgagtgcccccagggaggggctggggcgtctcagggtgcccactggcgagggagctggcatctccacccgcagtcctcgccccttcaatgagatcccctctcctggtgacaatggctggctaaacctgtaccatttctggagggagacgggcacacacaaagtccaccttcaccatgtccagaatttccagaagtatggcccgatttacaggaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatg

SEQ ID NO: 71481 - DNA, 2270 bp, Homo sapiens
atgcatttctcagaacttatccctgttgttcaatgatgtgtgtctatacagtggggccataactaagacgtatgttgcccaagctggcaagatagctctgaccttctcttgggcccctcatttcccccaaacacaggttgtctgcagtcttgaccaatggctgccagggcatggactccgctgcaggggccagtgggaggccccagctcaggcaaaagcacaggcagatatttcaggagtctgctagggctggcactgaggggcagagacagaggggtctccctgtcctttggagaacctcacgctgcagaaattccagactgaaccttcataccgagtaggggaggagctgtctgcgggtttgagcctgcagcaggaggaaggacgtgaacattttatcagcttctggtatggccttgagctggtagttataatcttggccctggtggcccagggctacagtcatcctagcagtccccgctgaagtggagcaggtacagtcacagctgtggggacagcatgctggccaagggtcttcccccacgctcagtcctggtcaaaggctgccagacctttctgagtgcccccagggaggggctggggcgtctcagggtgcccactggcgagggagctggcatctccacccgcagtcctcgccccttcaatgagatcccctctcctggtgacaatggctggctaaacctgtaccatttctggagggagacgggcacacacaaagtccaccttcaccatgtccagaatttccagaagtatggcccgatttacagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcggcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatg

SEQ ID NO: 71482 - DNA, 1323 bp, Homo sapiens
  misc_feature (78)..(78): n is a, c, g, or t
ggagacactaagacttcaccccatctccgtgaccctgcagagatatcttgtaaatgacttggttcttcgagattacangattcctgccaagacactggtgcaagtggccatctatgctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatg

SEQ ID NO: 71483 - DNA, 517 bp, Homo sapiens
gcagcactaagggtgcattatcaggcactgtgcagggttacaccaggagctggtggtgaactccttggaactcctcaaatcacactccacaggcactgcctatgggtgaattggcctggctagggagacagatcctcccctgccctcccctaaacctaccatctgcctttctcagatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatg

SEQ ID NO: 71484 - DNA, 2295 bp, Homo sapiens
atgcatttctcagaacttatccctgttgttcaatgatgtgtgtctatacagtggggccataactaagacgtatgttgcccaagctggcaagatagctctgaccttctcttgggcccctcatttcccccaaacacaggttgtctgcagtcttgaccaatggctgccagggcatggactccgctgcaggggccagtgggaggccccagctcaggcaaaagcacaggcagatatttcaggagtctgctagggctggcactgaggggcagagacagaggggtctccctgtcctttggagaacctcacgctgcagaaattccagactgaaccttcataccgagtaggggaggagctgtctgcgggtttgagcctgcagcaggaggaaggacgtgaacattttatcagcttctggtatggccttgagctggtagttataatcttggccctggtggcccagggctacagtcatcctagcagtccccgctgaagtggagcaggtacagtcacagctgtggggacagcatgctggccaagggtcttcccccacgctcagtcctggtcaaaggctgccagacctttctgagtgcccccagggaggggctggggcgtctcagggtgcccactggcgagggagctggcatctccacccgcagtcctcgccccttcaatgagatcccctctcctggtgacaatggctggctaaacctgtaccatttctggagggagacgggcacacacaaagtccaccttcaccatgtccagaatttccagaagtatggcccgatttacagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatg

SEQ ID NO: 71485 - DNA, 2317 bp, Homo sapiens
atgcatttctcagaacttatccctgttgttcaatgatgtgtgtctatacagtggggccataactaagacgtatgttgcccaagctggcaagatagctctgaccttctcttgggcccctcatttcccccaaacacaggttgtctgcagtcttgaccaatggctgccagggcatggactccgctgcaggggccagtgggaggccccagctcaggcaaaagcacaggcagatatttcaggagtctgctagggctggcactgaggggcagagacagaggggtctccctgtcctttggagaacctcacgctgcagaaattccagactgaaccttcataccgagtaggggaggagctgtctgcgggtttgagcctgcagcaggaggaaggacgtgaacattttatcagcttctggtatggccttgagctggtagttataatcttggccctggtggcccagggctacagtcatcctagcagtccccgctgaagtggagcaggtacagtcacagctgtggggacagcatgctggccaagggtcttcccccacgctcagtcctggtcaaaggctgccagacctttctgagtgcccccagggaggggctggggcgtctcagggtgcccactggcgagggagctggcatctccacccgcagtcctcgccccttcaatgagatcccctctcctggtgacaatggctggctaaacctgtaccatttctggagggagacgggcacacacaaagtccaccttcaccatgtccagaatttccagaagtatggcccgatttacagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatgtggtgtcttgcgttccatcaga

SEQ ID NO: 71486 - DNA, 2550 bp, Homo sapiens
atgcatttctcagaacttatccctgttgttcaatgatgtgtgtctatacagtggggccataactaagacgtatgttgcccaagctggcaagatagctctgaccttctcttgggcccctcatttcccccaaacacaggttgtctgcagtcttgaccaatggctgccagggcatggactccgctgcaggggccagtgggaggccccagctcaggcaaaagcacaggcagatatttcaggagtctgctagggctggcactgaggggcagagacagaggggtctccctgtcctttggagaacctcacgctgcagaaattccagactgaaccttcataccgagtaggggaggagctgtctgcgggtttgagcctgcagcaggaggaaggacgtgaacattttatcagcttctggtatggccttgagctggtagttataatcttggccctggtggcccagggctacagtcatcctagcagtccccgctgaagtggagcaggtacagtcacagctgtggggacagcatgctggccaagggtcttcccccacgctcagtcctggtcaaaggctgccagacctttctgagtgcccccagggaggggctggggcgtctcagggtgcccactggcgagggagctggcatctccacccgcagtcctcgccccttcaatgagatcccctctcctggtgacaatggctggctaaacctgtaccatttctggagggagacgggcacacacaaagtccaccttcaccatgtccagaatttccagaagtatggcccgatttacagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatcaatgtgagtcaagctggggacatctaggcaccctgggctggccctggccctaatgaaggcaccaatcttcctcctcctatctctgtccagagcccaaggatgtcagtgctggggcgcatctacctccagttacttgctctcgctctctcccacagttctctgctgccccctctttcgggctcaaccactcatcacccactgatgcccctggccatccattccccatggtggtgatgggatgggataggactgagatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatg

SEQ ID NO: 71487 - DNA, 2759 bp, Homo sapiens
atgcatttctcagaacttatccctgttgttcaatgatgtgtgtctatacagtggggccataactaagacgtatgttgcccaagctggcaagatagctctgaccttctcttgggcccctcatttcccccaaacacaggttgtctgcagtcttgaccaatggctgccagggcatggactccgctgcaggggccagtgggaggccccagctcaggcaaaagcacaggcagatatttcaggagtctgctagggctggcactgaggggcagagacagaggggtctccctgtcctttggagaacctcacgctgcagaaattccagactgaaccttcataccgagtaggggaggagctgtctgcgggtttgagcctgcagcaggaggaaggacgtgaacattttatcagcttctggtatggccttgagctggtagttataatcttggccctggtggcccagggctacagtcatcctagcagtccccgctgaagtggagcaggtacagtcacagctgtggggacagcatgctggccaagggtcttcccccacgctcagtcctggtcaaaggctgccagacctttctgagtgcccccagggaggggctggggcgtctcagggtgcccactggcgagggagctggcatctccacccgcagtcctcgccccttcaatgagatcccctctcctggtgacaatggctggctaaacctgtaccatttctggagggagacgggcacacacaaagtccaccttcaccatgtccagaatttccagaagtatggcccgatttacagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaaggtaggtgcagccagcaggctgcaggctctgccagtcagagagggctggggcaggctggaattgcagacagagggtggcactggggccctggtggggcccttgatggcagcagtctaagtctgaatgaagggcagaggtggtgggcatggtgggcggtgacctctaggatgttattggaacccagggttaggagggagacttcatgatttgcctgggtctgaggaaagggtgggacaatcatcctggccttgggtcttcagccatccccatttggtgggtaaggattacagaggggcggggccttgttcaaggctgcacagtgggcagaatgtcctgccctggagagctgggcagccatgctggggagtgggagtggtggtgagagggcaggggactagggaagggggttttgtgctcagggctgtggggaagtggggcttactcaggcctctgatcaccttgccccagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccgaacacggataggggatcctcta

SEQ ID NO: 71488 - DNA, 2431 bp, Homo sapiens
ccgggcatggtggcgggggtctataatcccagctactcgggaggctgaggcaggacactcgcccgaacccaggaggtgggaggttgcagtgagccgagatcatgtcactgcactcccgccctgggcaacaaaagcgaaactctgtctcaaaaaaaaaaaaaaaaaaaaaatcgggggagggagatttgaaggtcagagcacagagtgaaaaggtcgcagcgtggtcaagtttggcgctagcgacagacccagcattcctcccagcgcacgccgccgcccgggccgcgctattccgaaattgggtccgccctagcgtggcccccggcctgctcctgcgctcttcgcgggtcgctcacctccgcctcccctcgacacagcccgagcccatccgccccccgggtcgacccgcgtttacctcagggcgaggtccaggcgctcggccccgcggaggcggcggcggccccaccgcaggttcctaggtcccagtcactctgccgccaagttccccaacacggactccgtgcgctttgaggtgttacgggggcgctggagcactggcttcgctggccctgccaggaggcggcggcgaagcagggagcgacccggtatgcgtttctctgcccggcctgcggccctgcagcatccactcctcgcctctgctggcctctgccctcgctcgctgcgttcacccgagctcacccgagcccaccggagccgacagtggcgcgctaagcagcgctgcgagacaggtactgtatttgtctccattttacagaagaggaaactgagactcagaggggttaagggcctcgactcaggtcccacagtcagcaagttgtggaactgtgaggcagctgtgctgagcctgtatccatagctctcctcggatccttccatcagcccctctcccccacccctccagggggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatg

SEQ ID NO: 71489 - DNA, 1543 bp, Homo sapiens
tgagccaggatgagccaggagaaggaatttcacaagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatg

SEQ ID NO: 71490 - DNA, 1388 bp, Homo sapiens
gttagcggactgactctcttactaaccagcgctacaggaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatg

SEQ ID NO: 71491 - DNA, 1223 bp, Homo sapiens
atgcatttctcagaacttatccctgttgttcaatgatgtgtgtctatacagtggggccataactaagacgtatgttgcccaagctggcaagatagctctgaccttctcttgggcccctcatttcccccaaacacaggttgtctgcagtcttgaccaatggctgccagggcatggactccgctgcaggggccagtgggaggccccagctcaggcaaaagcacaggcagatatttcaggagtctgctagggctggcactgaggggcagagacagaggggtctccctgtcctttggagaacctcacgctgcagaaattccagactgaaccttcataccgagtaggggaggagctgtctgcgggtttgagcctgcagcaggaggaaggacgtgaacattttatcagcttctggtatggccttgagctggtagttataatcttggccctggtggcccagggctacagtcatcctagcagtccccgctgaagtggagcaggtacagtcacagctgtggggacagcatgctggccaagggtcttcccccacgctcagtcctggtcaaaggctgccagacctttctgagtgcccccagggaggggctggggcgtctcagggtgcccactggcgagggagctggcatctccacccgcagtcctcgccccttcaatgagatcccctctcctggtgacaatggctggctaaacctgtaccatttctggagggagacgggcacacacaaagtccaccttcaccatgtccagaatttccagaagtatggcccgatttacaggtaagcctggcagagggtgggagccgaagggacagggaggaggaggggcctgggtagccctgctgtagtccccactcccccaacaggctgttctctggttccaaactcctgtctaacttctttttttttttttggtaatacaatacataaatatatcagggatatttcaaaattcaacatttgaatctgtgaatgtcttaagtactctaaaccagacatctacttttgaaacaattggtggcaagaccgccagccatctgtaaggaagctctttaatgggtccaaaccccaagtctggccaggcatggtggctcacacccataatcccagcactttgggaggccgaggtgggcggatcacttgagatcaatagttcgaaaccatcctgcccaacatgattaaaccccgtctttactaaaaatacaaaaattagct

SEQ ID NO: 71492 - DNA, 1073 bp, Homo sapiens
ggtttctattgacttgggttaatcgtgtgaccgcggtggctggcacgaaattgaccaaccctggggttagtatagcttagttaaactttcgtttattgctaaaggttaatcactgctgtttcccgtgggggtgtggctaggctaagcgttttgagctgcattgctgcgtgcttgatgcttgtcccttttgatcgtggtgatttagagggtgaactcactggaatggggatgcttgcatgtgtaatcttactaagagctaatagaaaggctaggaccaaaccagaaacctccaattctcatgtggaagcccatgccctcaccctccaacatgaaagcctctgcagcacttctgtgtctgctgctcacagcagctgctttcagcccccaggggcttgctcagccagttgggattaatacttcaactacctgctgctacagatttatcaataagaaaatccctaagcagaggctggagagctacagaaggaccaccagtagccactgtccccgggaagctgtaatcttcaagaccaaactggacaaggagatctgtgctgaccccacacagaagtgggtccaggactttatgaagcacctggacaagaaaacccaaactccaaagctttgaacattcatgactgaactgaaaacaagccatgacttgagaaacaaataatttgtataccctgtcctttctcagagtggttctgagattattttaatctaattctaaggaatatgagctttatgtaataatgtgaatcatggtttttcttagtagattttaaaagttattaatattttaatttaatcttccatggattttggtgggttttgaacataaagccttggatgtatatgtcatctcagtgctgtaaaaactgtgggatgctcctcccttctctacctcatgggggtattgtataagtccttgcaagaatcagtgcaaagatttgctttaattgttaagatatgatgtccctatggaagcatattgttattatataattacatatttgcatatgtatgactcccaaattttcacataaaatagatttttgtataacagctgc

SEQ ID NO: 71493 - DNA, 339 bp, Homo sapiens
caataagaaaatccctaagcagaggctggagagctacagaaggaccaccagtagccactgtccccgggaagctgtaatgtatgtggacgatgaccacccacccctcacacctcagtcctaggttcttccctgggcagggaataggactagtatcagaatgagttggagtcaaatactgtgatgcatacagcatctctaaccttatcccagacatttgccagtgagaaacaatacaagtaaagaaagtggcttctcactctcagctccctttccagctatcattttacatctcagttcgttccttcatcctggaaccaagagagattcacttgggctacc

SEQ ID NO: 71494 - DNA, 352 bp, Homo sapiens
taaagactttatagagccaaggatcagtaagctatggcccatgggccaaatctagcctgcttttgatacagtcctcaagttaagaatggtttttacatttttaatggttggaagaactgtgctcaatcactgctattgaatgctgagtggctttgaaattagcttttgctgcagatttgaaaaggtttcaagctaaagttacaatgtaaaacagtgcttatacgtgaaacatactgtgataaaatcatttcatttcaacgagaacattgtttgaattgcaagtaatgtcaggctgcatcacatacttcctgcactgtcgaaaggttttttttttttctgttttttttttttt

SEQ ID NO: 71495 - DNA, 393 bp, Homo sapiens
ggaaaagcccttttgtaggagctgtgaagcctggattttagtccagattccaggaatctggaatccttggaaaaatcattgcccagttctaggccttggtttccccatctatataatgtccacactctgcaatcatagaacttccaaagtgagggggaatggtggtggctgctattttataattaataaggatggtaagtggctgagcgcagtggctcacgcctgtaatcccagcactttgggaggccgaggcaggaagatcacttacggctcggagttcaagactatcctggccaacatggcgaaaccccgtctctattaaataaacaaaaaatgagccaggcatggtggtcactgtactccagcctgggtgacagagcaaagtccgtctca

SEQ ID NO: 71496 - DNA, 822 bp, Homo sapiens
agacgttttggagaatctagaggatccacggtctgacccaccgagctgcccgagctgcttaaactttattaccggaggctctttccctactctcagtactatcgctggctcaactacggtggagtgataaagaattactttcaacaccgtgaattttcattcacattgaaagatgatatttacattcgctaccaatccttcaacaaccagagtgatctggaaaaggagatgcagaaaatgaatccatacaagattgatataggcgcagtatattctcacagacccaatcaacacaatacagtgaagctgggagctttccaggctcaggaaaaagaactggtatttgacattgacatgacagactatgacgatgtgaggagatgttgtagttctgcagacatatgtcctaagtgctggaccctcatgacaatggccatacgcatcattgacagagcattgaaggaggactttggatttaagcatcgtctctgggtatattctggaaggagaggtgttcattgttgggtctgtgatgaatcagttagaaaactgtcttctgcagtacgttctgggatagttgagtatttgagccttgtaaagggtgttacaagacgtttgaaaagatatatgatcacctaattgtgtctattcacccttttatccagaccatctatagacataatactcaatactttcaagaatatgccctggtgactctagatattctcagttcatcacgacgctgcgatatgatctctctcccttcttcatataaccagccatgatgcacttctcctaagtttcccttcgtctcacaattca

SEQ ID NO: 71497 - DNA, 1397 bp, Homo sapiens
gccggccgtgctgttcccgccaattcctgtggtaatccttaccgtggcgagttccgcgctcaatggagacgtttgaccccaccgagctgcccgagctgcttaaactttattaccggaggctctttccctactctcagtactatcgctggctcaactacggtggagtgataaagaattactttcaacaccgtgaattttcattcacattgaaagatgatatttacattcgctaccaatccttcaacaaccagagtgatctggaaaaggagatgcagaaaatgaatccatacaagattgatataggcgcagtatattctcacagacccaatcaacacaatacagtgaagctgggagctttccaggctcaggaaaaagaactggtatttgacattgacatgacagactatgacgatgtgaggagatgttgtagttctgcagacatatgtcctaagtgctggaccctcatgacaatggccatacgcatcattgacagagcattgaaggaggactttggatttaagcatcgtctctgggtatattctggaaggagaggtgttcattgttgggtctgtgatgaatcagttagaaaactgtcttctgcagtacgttctgggatagttgagtatttgagccttgtaaagggtggtcaagacgttaaaaagaaagttcacctaagtgaaaaaattcacccttttatcagaaaatctataaacataataaaaaaatactttgaagaatatgccttggttaatcaagatattctcgaaaataaagaaagctgggataagattttagcccttgttcctgaaaaaagcttccaaaagtctcacaattcacttcagcgttgggagcacttgaagaaagtagccagcagatatcagaataacatcaaaaatgacaaatatggaccctggctggagtgggagattatgctccagtactgttttccacggctggatatcaatgtcagcaaaggaatcaatcatctactgaagagcccttttagtgttcatcctaaaacaggtcgcatctctgtgcctattgatttgcagaaagtggaccagtttgatccatttactgttccgaccataagcttcatctgccgtgaattggatgccatttccactaatgaagaggaaaaagaggagaatgaagctgaatctgatgtcaaacatagaaccagagattataagaagaccagtctagcaccttatgtgaaagtttttgaacattttcttgaaaatctggataaatcccgaaaaggagaacttcttaagaagagtgatttacaaaaagatttctgaagacagagctcctcaaaccattgtggatatcttctgccttcaaccacagatcaaatacttcaagagccatttaataaatatggcagaactata

SEQ ID NO: 71498 - DNA, 856 bp, Homo sapiens
gccggccgtgctgttcccgccaattcctgtggtaatccttaccgtggcgagttccgcgctcaatggagacgtttgaccccaccgagctgcccgagctgcttaaactttattaccggaggctctttccctactctcagtactatcgctggctcaactacggtggagtgataaagaattactttcaacaccgtgaattttcattcacattgaaagatgatatttacattcgctaccaatccttcaacaaccagagtgatctggaaaaggagatgcagaaaatgaatccatacaagattgatataggcgcagtatattctcacagacccaatcaacacaatacagtgaagctgggagctttccaggctcaggaaaaagaactggtatttgacattgacatgacagactatgacgatgtgaggagatgttgtagttctgcagacatatgtcctaagtgctggaccctcatgacaatggccatacgcatcattgacagagcattgaaggaggactttggatttaagcatcgtctctgggtatattctggaaggagaggtgttcattgttgggtctgtgatgaatcagttagaaaactgtcttctgcagtacgttctgggatagttgagtatttgagccttgtaaagggtggtcaagacgttaaaaagaaagttcacctaagtgaaaaaattcacccttttatcagaaaatctataaacataataaaaaaatactttgaagaatatgccttggttaatcaagatattctcgaaaataaagaaagctgggatcacgccactgcactccatcctgggcaacataaataaaaattataaaataaataaaacgtattaaacttgtg

SEQ ID NO: 71499 - DNA, 1087 bp, Homo sapiens
gccggccgtgctgttcccgccaattcctgtggtaatccttaccgtggcgagttccgcgctcaatggagacgtttgaccccaccgagctgcccgagctgcttaaactttattaccggaggctctttccctactctcagtactatcgctggctcaactacggtggagtgataaagaattactttcaacaccgtgaattttcattcacattgaaagatgatatttacattcgctaccaatccttcaacaaccagagtgatctggaaaaggagatgcagaaaatgaatccatacaagattgatataggcgcagtatattctcacagacccaatcaacacaatacagtgaagctgggagctttccaggctcaggaaaaagaactggtatttgacattgacatgacagactatgacgatgtgaggagatgttgtagttctgcagacatatgtcctaagtgctggaccctcatgacaatggccatacgcatcattgacagagcattgaaggaggactttggatttaagcatcgtctctgggtatattctggaaggagaggtgttcattgttgggtctgtgatgaatcagttagaaaactgtcttctgcagtacgttctgggatagttgagtatttgagccttgtaaagggtggtcaagacgttaaaaagaaagttcacctaagtgaaaaaattcacccttttatcaggtctgttggaaaagtctccaagcactttaaggtgtctgatttaccggcatgtgcctttagagttaccttgctatcaattttcactgctgggtagcattttataataataatagctatggttaattgagtgcctattttatgctgcagtattcctaaaaggtgctttacagatgttctcattgctcttcaaaaaaaccccacaagagacttgatggtatctccatttatagataaggaaaatgagttttagagagattttataatgagcttggcatcacacgacaagttagttgttaaatttaggattcatgccctggtctgcctgactgtaaagcctactccaatgctttttccactgaattcactacttctctaggatagtggaaa

SEQ ID NO: 71500 - DNA, 1431 bp, Homo sapiens
gccggccgtgctgttcccgccaattcctgtggtaatccttaccgtggcgagttccgcgctcaatggagacgtttgaccccaccgagctgcccgagctgcttaaactttattaccggaggctctttccctactctcagtactatcgctggctcaactacggtggagtgataaagaattactttcaacaccgtgaattttcattcacattgaaagatgatatttacattcgctaccaatccttcaacaaccagagtgatctggaaaaggagatgcagaaaatgaatccatacaagattgatataggcgcagtatattctcacagacccaatcaacacaatacagtgaagctgggagctttccaggctcaggaaggtgagcactgtgtgtcttgctgttagggtgggtggtatcactgacaatgagtaatgatgactctgctttagttctgcagacatatgtcctaagtgctggaccctcatgacaatggccatacgcatcattgacagagcattgaaggaggactttggatttaagcatcgtctctgggtatattctggaaggagaggtgttcattgttgggtctgtgatgaatcagttagaaaactgtcttctgcagtacgttctgggatagttgagtatttgagccttgtaaagggtggtcaagacgttaaaaagaaagttcacctaagtgaaaaaattcacccttttatcagaaaatctataaacataataaaaaaatactttgaagaatatgccttggttaatcaagatattctcgaaaataaagaaagctgggataagattttagcccttgttcctgaaacaattcatgatgaacttcaacaaagcttccaaaagtctcacaattcacttcagcgttgggagcacttgaagaaagtagccagcagatatcagaataacatcaaaaatgacaaatatggaccctggctggagtgggagattatgctccagtactgttttccacggctggatatcaatgtcagcaaaggaatcaatcatctactgaagagcccttttagtgttcatcctaaaacaggtcgcatctctgtgcctattgatttgcagaaagtggaccagtttgatccatttactgttccgaccataagcttcatctgccgtgaattggatgccatttccactaatgaagaggaaaaagaggagaatgaagctgaatctgatgtcaaacatagaaccagagattataagaagaccagtctagcaccttatgtgaaagtttttgaacattttcttgaaaatctggataaatcccgaaaaggagaacttcttaagaagagtgatttacaaaaagatttctgaagacagagctcctcaaaccattgtggatatcttctgccttcaaccacagatcaaatacttcaagagccatttaataaatatggcagaactata

SEQ ID NO: 71501 - DNA, 863 bp, Homo sapiens
gccggccgtgctgttcccgccaattcctgtggtaatccttaccgtggcgagttccgcgctcaatggagacgtttgaccccaccgagctgcccgagctgcttaaactttattaccggaggctctttccctactctcagtactatcgctggctcaactacggtggagtgataaagaattactttcaacaccgtgaattttcattcacattgaaagatgatatttacattcgctaccaatccttcaacaaccagagtgatctggaaaaggagatgcagaaaatgaatccatacaagattgatataggcgcagtatattctcacagacccaatcaacacaatacagtgaagctgggagctttccaggctcaggaaaaagaactggtatttgacattgacatgacagactatgacgatgtgaggagatgttgtagttctgcagacatatgtcctaagtgctggaccctcatgacaatggccatacgcatcattgacagagcattgaaggaggactttggatttaagcatcgtctctgggtatattctggaaggagaggtgttcattgttgggtctgtgatgaatcagttagaaaactgtcttctgcagtacgttctgggatagttgagtatttgagccttgtaaagggtgttacaagacgtttgaaaagatatatgatcacctaattgtgtctattcacccttttatccagaccatctatagacataatactcaatactttcaagaatatgccctggtgactctagatattctcagttcatcacgacgctgcgatatgatctctctcccttcttcatataaccagccatgatgcacttctcctaagtttcccttcgtctcacaattca

SEQ ID NO: 71502 - DNA, 863 bp, Homo sapiens
tgtcatccaggctggagtgcagtggcatgatctcggctcactgcagcctccgcctcccgggttcaagcgattctcctgcctcaccctcccgagtagctgggattacaggtcgcatctctgtgcctattgatttgcagaaagtggaccagtttgatccatttactgttccgaccataagcttcatctgccgtgaattggatgccatttccactaatgaagaggaaaaagaggagaatgaagctgaatctgatgtcaaacatagaaccagagattataagaagaccagtctagcaccttatgtgaaagtttttgaacattttcttgaaaatctggataaatcccgaaaaggagaacttcttaagaagagtgatttacaaaaagatttctgaagacagagctcctcaaaccattgtggatatcttctgccttcaaccacagatcaaatacttcaagagccatttaataaatatggcagaactatatatgtgtcttaaacctcaaagtaaattttccttgagaaataatttatgttgaaaagatttcctggccaagtgctgggattaccgggtgttgaagccaacaaccgaactgaggccaggagttcaacggccagcctggcaaacatggtgaaacccggtctccataaaaatacagaaattagcaggtggtggtgcggcacctgtatcccaggtacctaagaacggtgggcgcacaaagaattcactggacccatgaggtggaggtacacggaattggaaacaagcccatggactccacctggggcaacataattaaaatttaacatcattaaacgtttacacctttgtgaaacaaaacacaccacaaggggcggcgaaaaagag

SEQ ID NO: 71503 - DNA, 526 bp, Homo sapiens
tataagccaatatgaaaaaaatcagcagattgaatattattcaagagatgaaggctactctagaaaactgtgacaatgttatagcaatacaaattatcttgccacttcattttttatttaaatatgtgatagtttaagcagtagtgcctaagataatgctctactcagtagacactcatatgtgtgattattggatgaacaacaactctgagcttggaaagcctggttgaagctgccattgcaactggccgtattaagtcctttgtatcctcactgttccatactagctcagcctatgatgtggacttcagcaaatgtgtaagcaaatctttgtgcatgatgtgtgttaaatagaagcattaggcaaaaaagaatgtaaaagtaaatgggctttgttttgtttcctttgctgttcttccatatattatctattctattttagatttacaaaaagatttctgaagacagagctcctcaaaccattgtggatatcttctgccttcaaccacagatcaaatacttcaag

SEQ ID NO: 71504 - DNA, 1418 bp, Homo sapiens
gccggccgtgctgttcccgccaattcctgtggtaatccttaccgtggcgagttccgcgctcaatggagacgtttgaccccaccgagctgcccgagctgcttaaactttattaccggaggctctttccctactctcagtactatcgctggctcaactacggtggagtgataaagaattactttcaacaccgtgaattttcattcacattgaaagatgatatttacattcgctaccaatccttcaacaaccagagtgatctggaaaaggagatgcagaaaatgaatccatacaagattgatataggcgcagtatattctcacagacccaatcaacacaatacagtgaagctgggagctttccaggctcaggaaaaagaactggtatttgacattgacatgacagactatgacgatgtgaggagatgttgtagttctgcagacatatgtcctaagtgctggaccctcatgacaatggccatacgcatcattgacagagcattgaaggaggactttggatttaagcatcgtctctgggtatattctggaaggagaggtgttcattgttgggtctgtgatgaatcagttagaaaactgtcttctgcagtacgttctgggatagttgagtatttgagccttgtaaagggtggtcaagacgttaaaaagaaagttcacctaagtgaaaaaattcacccttttatcagaaaatctataaacataataaaaaaatactttgaagaatatgccttggttaatcaagatattctcgaaaataaagaaagctgggataagattttagcccttgttcctgaaacaattcatgatgaacttcaacaaagcttccaaaagtctcacaattcacttcagcgttgggagcacttgaagaaagtagccagcagatatcagaataacatcaaaaatgacaaatatggaccctggctggagtgggagattatgctccagtactgttttccacggctggatatcaatgtcagcaaaggaatcaatcatctactgaagagcccttttagtgttcatcctaaaacaggtcgcatctctgtgcctattgatttgcagaaagtggaccagtttgatccatttactgttccgaccataagcttcatctgccgtgaattggatgccatttccactaatgaagaggaaaaagaggagaatgaagctgaatctgatgtcaaacatagaaccagagattataagaagaccagtctagcaccttatgtgaaagtttttgaacattttcttgaaaatctggataaatcccgaaaaggagaacttcttaagaagagtgatttacaaaaagatttctgaagacagagctcctcaaaccattgtggatatcttctgccttcaaccacagatcaaatacttcaagagccatttaataaatatggcagaactata

SEQ ID NO: 71505 - DNA, 1799 bp, Homo sapiens
gccggccgtgctgttcccgccaattcctgtggtaatccttaccgtggcgagttccgcgctcaatggagacgtttgaccccaccgagctgcccgagctgcttaaactttattaccggaggctctttccctactctcagtactatcgctggctcaactacggtggagtgataaagaattactttcaacaccgtgaattttcattcacattgaaagatgatatttacattcgctaccaatccttcaacaaccagagtgatctggaaaaggagatgcagaaaatgaatccatacaagattgatataggcgcagtatattctcacagacccaatcaacacaatacagtgaagctgggagctttccaggctcaggaaaaagaactggtatttgacattgacatgacagactatgacgatgtgaggagatgttgtagttctgcagacatatgtcctaagtgctggaccctcatgacaatggccatacgcatcattgacagagcattgaaggaggactttggatttaagcatcgtctctgggtatattctggaaggagaggtgttcattgttgggtctgtgatgaatcagttagaaaactgtcttctgcagtacgttctgggatagttgagtatttgagccttgtaaagggtggtcaagacgttaaaaagaaagttcacctaagtgaaaaaattcacccttttatcagaaaatctataaacataataaaaaaatactttgaagaatatgccttggttaatcaagatattctcgaaaataaagaaagctgggataagattttagcccttgttcctgaaacaattcatgatgaacttcaacaaagcttccaaaagtctcacaattcacttcagcgttgggagcacttgaagaaagtagccagcagatatcagaataacatcaaaaatgacaaatatggaccctggctggagtgggagattatgctccagtactgttttccacggctggatatcaatgtcagcaaaggaatcaatcatctactgaagagcccttttagtgttcatcctaaaacaggtcgcatctctgtgcctattgatttgcagaaagtggaccagtttgatccatttactgttccgaccataagcttcatctgccgtgaattggatgccatttccactaatgaagaggaaaaagaggagaatgaagctgaatctgatgtcaaacatagaaccagagattataagaagaccagtctagcaccttatgtgaaagtttttgaacattttcttgaaaatctggataaatcccgaaaaggagaacttcttaagaagagtgatttacaaaaagatttctgaagacagagctcctcaaaccattgtggatatcttctgccttcaaccacagatcaaatacttcaagagccatttaataaatatggcagaactatatatgtgtcttaaacctcaaagtaaattttccttgagaaataatttatgttgaaaagatttcctggccaagtgctgggattaccgggtgttgaagccaacaaccgaactgaggccaggagttcaacggccagcctggcaaacatggtgaaacccggtctccataaaaatacagaaattagcaggtggtggtgcggcacctgtatcccaggtacctaagaacggtgggcgcacaaagaattcactggacccatgaggtggaggtacacggaattggaaacaagcccatggactccacctggggcaacataattaaaatttaacatcattaaacgtttacacctttgtgaaacaaaacacaccacaaggggcggcgaaaaagag

SEQ ID NO: 71506 - DNA, 1491 bp, Homo sapiens
gccggccgtgctgttcccgccaattcctgtggtaatccttaccgtggcgagttccgcgctcaatggagacgtttgaccccaccgagctgcccgagctgcttaaactttattaccggaggctctttccctactctcagtactatcgctggctcaactacggtggagtgataaagaattactttcaacaccgtgaattttcattcacattgaaagatgatatttacattcgctaccaatccttcaacaaccagagtgatctggaaaaggagatgcagaaaatgaatccatacaagattgatataggcgcagtatattctcacagacccaatcaacacaatacagtgaagctgggagctttccaggctcaggaaaaagaactggtatttgacattgacatgacagactatgacgatgtgaggagatgttgtagaggtgagcactgtgtgtcttgctgttagggtgggtggtatcactgacaatgagtaatgatgactctgctttagttctgcagacatatgtcctaagtgctggaccctcatgacaatggccatacgcatcattgacagagcattgaaggaggactttggatttaagcatcgtctctgggtatattctggaaggagaggtgttcattgttgggtctgtgatgaatcagttagaaaactgtcttctgcagtacgttctgggatagttgagtatttgagccttgtaaagggtggtcaagacgttaaaaagaaagttcacctaagtgaaaaaattcacccttttatcagaaaatctataaacataataaaaaaatactttgaagaatatgccttggttaatcaagatattctcgaaaataaagaaagctgggataagattttagcccttgttcctgaaacaattcatgatgaacttcaacaaagcttccaaaagtctcacaattcacttcagcgttgggagcacttgaagaaagtagccagcagatatcagaataacatcaaaaatgacaaatatggaccctggctggagtgggagattatgctccagtactgttttccacggctggatatcaatgtcagcaaaggaatcaatcatctactgaagagcccttttagtgttcatcctaaaacaggtcgcatctctgtgcctattgatttgcagaaagtggaccagtttgatccatttactgttccgaccataagcttcatctgccgtgaattggatgccatttccactaatgaagaggaaaaagaggagaatgaagctgaatctgatgtcaaacatagaaccagagattataagaagaccagtctagcaccttatgtgaaagtttttgaacattttcttgaaaatctggataaatcccgaaaaggagaacttcttaagaagagtgatttacaaaaagatttctgaagacagagctcctcaaaccattgtggatatcttctgccttcaaccacagatcaaatacttcaagagccatttaataaatatggcagaactata

SEQ ID NO: 71507 - DNA, 1237 bp, Homo sapiens
gccggccgtgctgttcccgccaattcctgtggtaatccttaccgtggcgagttccgcgctcaatggagacgtttgaccccaccgagctgcccgagctgcttaaactttattaccggaggctctttccctactctcagtactatcgctggctcaactacggtggagtgataaagaattactttcaacaccgtgaattttcattcacattgaaagatgatatttacattcgctaccaatccttcaacaaccagagtgatctggaaaaggagatgcagaaaatgaatccatacaagattgatataggcgcagtatattctcacagaaggactttggatttaagcatcgtctctgggtatattctggaaggagaggtgttcattgttgggtctgtgatgaatcagttagaaaactgtcttctgcagtacgttctgggatagttgagtatttgagccttgtaaagggtggtcaagacgttaaaaagaaagttcacctaagtgaaaaaattcacccttttatcagaaaatctataaacataataaaaaaatactttgaagaatatgccttggttaatcaagatattctcgaaaataaagaaagctgggataagattttagcccttgttcctgaaacaattcatgatgaacttcaacaaagcttccaaaagtctcacaattcacttcagcgttgggagcacttgaagaaagtagccagcagatatcagaataacatcaaaaatgacaaatatggaccctggctggagtgggagattatgctccagtactgttttccacggctggatatcaatgtcagcaaaggaatcaatcatctactgaagagcccttttagtgttcatcctaaaacaggtcgcatctctgtgcctattgatttgcagaaagtggaccagtttgatccatttactgttccgaccataagcttcatctgccgtgaattggatgccatttccactaatgaagaggaaaaagaggagaatgaagctgaatctgatgtcaaacatagaaccagagattataagaagaccagtctagcaccttatgtgaaagtttttgaacattttcttgaaaatctggataaatcccgaaaaggagaacttcttaagaagagtgatttacaaaaagatttctgaagacagagctcctcaaaccattgtggatatcttctgccttcaaccacagatcaaatacttcaagagccatttaataaatatggcagaactata

SEQ ID NO: 71508 - DNA, 721 bp, Homo sapiens
gccggccgtgctgttcccgccaattcctgtggtaatccttaccgtggcgagttccgcgctcaatggagacgtttgaccccaccgagctgcccgagctgcttaaactttattaccggaggctctttccctactctcagtactatcgctggctcaactacggtggagtgataaagaattactttcaacaccgtgaattttcattcacattgaaagatgatatttacattcgctaccaatccttcaacaaccagagtgatctggaaaaggagatgcagaaaatgaatccatacaagattgatataggcgcagtatattctcacagacccaatcaacacaatacagtgaagctgggagctttccaggctcaggaaaaagaactggtatttgacattgacatgacagactatgacgatgtgaggagatgttgtagaggtgagcactgtgtgtcttgctgttagggtgggtggtatcactgacaatgagtaatgatgactctgctttagttctgcagacatatgtcctaagtgctggaccctcatgacaatggccatacgcatcattgacagagcattgaagggcaagtatcagcagtttctgaatggggtcaagtgtaagaatcggttttcctctgactactattaactattagtctctgtattttgtgatcaaatctcattaatttgtgtgtgtgtgtattgtgtgatatttgtgtgtgtgtgtg

SEQ ID NO: 71509 - DNA, 280 bp, Homo sapiens
tggtgaaggaaccaacctgaaagacaaacagaaagaaacgctggcaggtggggagttaggggagtccgtgaagggcatggcactcaccaggaaccagcgcaacgccccctgcagcctgatcttcctggcaccgaagcacacggcctgggagcttgtggaagacacaacattccgattcagtagctcctgagagtctgtgtttccaacaaactctcactgctgccggcctggggaccacacttagagactaagaattgcgtttgctgcttctcccaccttc

SEQ ID NO: 71510 - DNA, 1458 bp, Homo sapiens
tacccattctcctgttaatggacatttgggttgtttccaggttttgactattatgaagaaagctgtagtgaacattctcatacatgcttttggagaacctcggtgcttatttctgtgggtatatatacctgggaatggaattgctaggtccttgggtggcttatgtttagctttaatagataccaccaccaaacagttttctaaagtgtttgtgctaatttatactcatattggcaacaaatgagcattctagttgctctttatcctggccaatggtgttaccaatctttttaattttagccactctggtagatgtgtagtggtttaattttcatatccttgatgactaaatgatgataccttttcatttgcttattggccagtcaatcctcttttatagaatgtctgtccaagttgtcattccggtcttaaattgagttgtatgtgtatgtgttgatttgtaggaactctttatatattacagatataagtcttttattggacaaaaatagtatatttatcaagtatctttttctagtctataaggcttgacttttaaacctcctaatagtatttttattgaacagaggttcttttaatgatgtgcagtttatcagtctttttgtttatggtttgcttggtttttgtcccatttaagagatattcatctcccccaaggatctgaaggtatttgcctatattatcttctagaagctttagtgatttatctttcaaaattaggtttatgatctttctgggattaatttttgtgtgtggtgttagaagtcaaacctcatatttttccatatggatatctgattggcctcactgtttcttgaatatgaccatgtaaatcacaaaactgtcagtgtgggtcagagtcttcgaatttgctatcctgaagatgcttcagtacatcctgaagatttgcttcctgaaaatgaatgctctaggaccctgaaggttgtgactgtgcacctgccaactcaagctgaaggctgaagaggaaagctctgcagccccttcctcaagctggaggcagagtgacgtctgctggggatgcaggctgtgcgccccacaggactccagagtggcactaagcatgttgagttcactcctgcccatggtctagcttctgctttgcaggctcaggcatcttatcttgccagggcctcaaagctggtgggacagaatagcatctttgctcactaagctctgacccaccggcctccttgcagctctatagtccaagcgaactccttccaacatcaggcttcttttaaaaaaaaaaatttttttgaggcagagtctcactctgtcacccaggctgaagtacagtggtgcaatctcagctcactgaaacctccgcctcctaagttcaactgattctcatgcctcagcctcccaagtagctgggattacagatgcctaccaccatgcccagctaatttttgtatt

SEQ ID NO: 71511 - DNA, 749 bp, Homo sapiens
aaattggccctcaagccaagaattcggcacgagtttatgatctttctgggattaatttttgtgtgtggtgttagaagtcaaacctcatatttttccatatggatatctgattggcctcactgtttcttgaatatgaccatgtaaatcacaaaactgtcagtgtgggtcagagtcttcgaatttgctatcctgaagatgcttcagtacatcctgaagatttgcttcctgaaaatgaatgctctaggaccctgaaggttgtgactgtgcacctgccaactcaagctgaaggctgaagaggaaagctctgcagccccttcctcaagctggaggcagagtgacgtctgctggggatgcaggctgtgcgccccacaggactccagagtggcactaagcatgttgagttcactcctgcccatggtctagcttctgctttgcaggctcaggcatcttatcttgccagggcctcaaagctggtgggacagaatagcatctttgctcactaagctctgacccaccggcctccttgcagctctatagtccaagcgaactccttccaacatcaggcttcttttaaaaaaaaaaatttttttgaggcagagtctcactctgtcacccaggctgaagtacagtggtgcaatctcagctcactgaaacctccgcctcctaagttcaactgattctcatgcctcagcctcccaagtagctgggattacagatgcctaccaccatgcccagctaatttttgtatt

SEQ ID NO: 71512 - DNA, 274 bp, Homo sapiens
agcaaggccccatctctacaaaaaaaaaaacaaacccaaaattccccgagtgtcatggcacttacctatagtcccagctactgggagggatgaggtgggaggatcgcttgagcctgggagtttgaggctacaatgagccatgataggaccactgaactccatcctgagtgacacagcaaggtcctgtttctaaagaaaaaaaggacattggaatcaggatcccctccatcctaaggtacctacaaggcatctctctctgcaaacaagtaaacat

SEQ ID NO: 71513 - DNA, 513 bp, Homo sapiens
gcttcctattttttcaggccccaaacttccttcatctcttcaaatgccttcaagggccagacagggaagccttcctgcattaagtgggcagctgggattatctccagtggcaaacttaggaccgtcaacggcagatttttactaagtgggaatgcaagctgagaattcctacatcatctgtttatttgtttaagagaagcctgaaatctggatctctaagtgaaatgtcccaatattttaatgttgacaataaattcacataaaaaaaataccatgtgggccaaataaaacatgtcacaatatactactttgggatctctctttctcatatctatctaggcagacgccaggcctgtttgttttaactctgaactctcttttctcttcattactttctcttctcctcatcactttctcttctcctcatcactttctcttctcctcatcctatttctggctctttgtcccaattaggtagtcatttaaaataataatgaaatctatttattagta

SEQ ID NO: 71514 - DNA, 516 bp, Homo sapiens
taacaagatagctctcagcaatgagaatgactcatcactgacttggtaataattctagggaaaatatatggtttgtggccaccccagcagtccactcagcctcttcctggcctgttagagaaggctcttccttcaggtgttatctgcaccacgaataatgttaggtttgagtcacctccctctaggacacctttccttaaagaggaaatgtttcctggagctggtagtcagggagcactgagagaaagcatttctcactgtgagttatcaatctctgtgcccattttgcataaccaattgccattttgtggcagtatttcatatctaaaatgattttccagagctggaccatggctcatgcctgtagtggtgcatgcctgaagtcccagctacccaggaggctgaggaaggaggactgattgagcctgggaggtcaaggctgcagtgagtggtgatagtgccactgcactccagcctgggtgacagagtgagacccctgtctcaaaaaaatgatac

SEQ ID NO: 71515 - DNA, 468 bp, Homo sapiens
ctcaaaaaaaaaaaaaatcaattaatgcacgcataatatagagacagagtcattgttaccattctcttattttgcctttgacaagtttatattgagcacgttatcaggcaatgtgggagattctggagaaccaggtttgcctcataactagggttaccatatactctagtttgcctggggcaaccctgatttatgcctgttgtcccagtgtgattattactagtgtaatttttcactttgagaagtgtccaggtttggaggataaattatctttctaataattgatacccttctcataacctaacgggttccttttagtattttatctgggttaaaattaccagctgtaatttggcagctctaataagactgcagcaatacttatcttccatttgaacagattgttacttgaccaagggaagttaatagcaaaagtaactgcagggcacatgtatgtcatgggcaaaa

SEQ ID NO: 71516 - DNA, 441 bp, Homo sapiens
gcttaacttgggaggtagaagttgcagtgagcggagactgcgccactgcgctccagcctgagtgatagaggggagactccatctcaaaaaaaaaaaaaagcaagtagatacaacaccttagttgttgccttccattgttacagatggctcctctgagagacgaatgtacttggccttcctacatagcatgatgctttcaacacttgatgctattgaagatgtaaatgttttccatcttctccctcccctttcattttccttcctatttcttcccctgtggtttctcttttctctctctggtataaaaatgctggaaagtgatacactaaaatgttaacagtagttgtctctagtgagtgtgactgtggataggtaattttctttacctctccactttctactttcacctttgccaatgttaagtcagtcagcaaacttaaa

SEQ ID NO: 71517 - DNA, 421 bp, Homo sapiens
tcatgcctgtaatacccgtactttgggaggctgaggagggaggactgtttgagcccaggagtttgacaccagcctgggcattacagtgaaaccccatctctacaaaaaattttaaaacttagccaggcgtggtggcgtatgcctgtagttccagctatttgggaggccaaggctgcagtgggctgtgattgtgccactgcactccagcccaagtgatagagcaagactctatctcaaaaatcaaacaacaacaacaacaaaacaccacatacacacacacaatgagggtaaacaaaataagtatgtgtgggtcacacttcagcaggggttgctggtttgccagagaaaagtgcaattattttatctatggtgtttattgtctccactctaaactgtcagttacagaatggcaagactgttt

SEQ ID NO: 71518 - DNA, 523 bp, Homo sapiens
gtttttttttttaaagggacaaataatgaatgatagagcagtcacacagattgagatacaaagtagaaatgtgactgccagaagctgggtggtagggggatagggagttagtaatattgggtacagagtttcaattttgcaagatgaaaagttctggagatggatggtggtgatagctacacaatgtccttaatgccactgaacatttaaaatggttagaatgataaattttatgttatgtgtattttactacaacttaaaaaaaaagcataaaaagataagccaaaattaaaaatcaagccacataatgtaagatagacaatatcatataaataacataaagaactcctacaaatctggctgggcacagtggctcacgcttgtaatcccagcactttgggatgccgagatgggcagattgcctgaggtcaggaagagaccagcctggctaacaaagcgaaaccctgactccagaacaagactccagccttactccagagcaagaactgtctcaaaaaaaaaa

SEQ ID NO: 71519 - DNA, 380 bp, Homo sapiens
tccacagccagcagccttcccggaatagcagctggggaggacccctaattaccctcacccacaaatgagaggttgtgcccagctgactggcgggaggctcggggctgtcagagggccccgaggcaaacagagcagcttctgggaatgaaggactttggtgagatgaggtagacacatgaaaatgccctcagctgtccagactggcccttacctgcccacctcagctggggaaactggaagctaaagagtgagtcctattcccacagaactctgggcatgctgagcgcacaggaggggaatgcaaggcctccaatggaaaactggagaaactgaggcccagagaggcatatgggcctattgggagtcagctgagtcaggga

SEQ ID NO: 71520 - DNA, 449 bp, Homo sapiens
gcccaggctggagcacatcagtgcagtcccagctcgttgcatcctcaacctactgggctcaagcaatcctcccacctcagcttcctgagcagctgggaccacaggtgcacaccaccatgcccggctgattttttacttttttgatagagacagggtctcactatgttgcccaggctagtcttgaactcctggacacaagtgattctcgagcctcggcctcccgaagcgctgggattacaggtgtgagccaccatgccctgcctcacgtttttctgaaatcaaaatagagtaactggttataaagtttacccatcaaaagaagaaactgactttgcattttattctttgtcataaaatctgcctggatgcttagtattatattattgtttactattatatattattccagagtaatggctttaacctcaacttcagaatcattcttgttg

SEQ ID NO: 71521 - DNA, 343 bp, Homo sapiens
gcacaaaatatatacttaatctttatttataatcttgtggtagcagagatctttgtaagcatgataccaatagcagaaactaaataaattttaaaaagagatcttacagccagccacggtggctcatgcctgtaattgcagcactttgggaggccaaggcgggcagatcacctgaggttggagtttgagaccagcctgaccaacatggagaaaccccatctctactaaaaatacagaattaccctggcgtggtggtgcatgtctgaaatcccagctactcgggaggctgaggcaggagaattgcttgaacctgggaggcagagattgcagtgagccgagattg

SEQ ID NO: 71522 - DNA, 272 bp, Homo sapiens
tcactggccttgcttgtaccaggtgtcattgtagggttagcagtgagctatgcctgttgtctttcttgtcaataggtaatactgtgtcatattcatttccccactgctaacacattaggctcttctgtgccattttctggcctcggtactatcttccatcatctcctgctttgtgcctgtgagcccaggtcctccagggtgctgggctggtttcattggaaggcccagcctggaaacagccgtcttcagctgcccttgtttcttgtttgttt

SEQ ID NO: 71523 - DNA, 612 bp, Homo sapiens
gtaccacaaaggcaaatgaggaaatgactccccccacctcacacacatggaatatttaaacaaaaatgccctgctaatctttagagatgccagtgttttcaacacatgaaaggtacccagtaaatatttaaagaaaatacacaccgtaggttctctaatgaatttctttttcttctaaataccatctggcaagatggccagaatcgtggcggtccgtttcatcttaacgtttccattcaggtttcacctccttttccataaggccttggtgtgagctgagattgaatgtttaattgaagaggacataattttcacacatacagcaaagatttgatgaggctttgaggtttattgtagccattaaagtgtcgtagctgctggcaaaatcccagaaaatgtctaaagctaaaccagatgtgattagcaaatttcaagaagtatcaggccctagatctccaggcaggcagagtcttttaaaaaaaaaaaaaaaactcgagggggggccgtacccattcggcctatatgaagcgtatacgccgctaacttgcctcgtttacacgtgggattgaaaaccccgcgttacaacttaatgcttggaaacatccctttgca

SEQ ID NO: 71524 - DNA, 712 bp, Homo sapiens
ctgcgttggtccctccaccccatcctgcaccacacggggtggcttgccttccccacaccacagaggaggaagctggctgggtcagctctcggggccctgctttgtagagaagggacagaggctcagaagtgaacccacttgcccaggtcacttccaatccatggctaaggattggaatccagacagcctgattccagagctcaaggctccaacctctccccagtgacctctttgagcaatgccctggattcagattgatgaagaggcagacatagagacccagcccctcccagctagaggtgtggggcttaccagatacctgccccagagctagaggtgaagcccctgtggcgcacgcagttcaggacctgcatgagtgttgacagggccctaagaagaaccacatggagcagtgttgccacagggctgctggcagcaaacattcacaggtctgggccagagcagcttccggaacctccaggccacctctcagaggactcggtccctgccctccctctgttctattggtcgcaggcctccccctgtcccagccccagctaccggggtcttccagggcctggggattgtgggcaggtggcatggagcggatgagcagaactgttgattgacaagcgaagctggtctagcaacagctgcagcacaagccaggtggaagtgtgctgcccttcagcttgagatggtccagggtgag

SEQ ID NO: 71525 - DNA, 342 bp, Homo sapiens
cggggtttcaccatgttggccaggctggtctcgaactcctgacctcaagtgatccgtccaccttggcctcccaaagtatgtgttaggattacaggcataagccaccgcacccagcctacatctataacaatagcaaaatagaaactgcatttaagttgtacttaagttataattaaagtaaatcacattaagtcatattgctcaaagggcagcaaaacttaattggcagatttctgcgtggctatgttttggtttctcaactactattttgaaagcatgttcttgaatcatcttcacctgaaagctctacatcttgtaagtagagctgacaggtttaattct

SEQ ID NO: 71526 - DNA, 483 bp, Homo sapiens
  misc_feature (464)..(464): n is a, c, g, or t
ttgcttggttcatggggccttaaacatttcaacatttgtccttcacaagataattatttcattaaaagtaaattacaatttattcagtagctctccacatgaaaataataatcagatggtaaatggatgccctaagatatgtggagaacaaattaccgtggtattttaaaggagagagttttctaagctaacttttatgcatgcagcatctccctggctaacatgagcattgatgataatttctaccattaatgagctcatttttttttttaatgagactttgtttttacttttaaaaaacagtaacctaaggcaggtgaagtcaaattgttattgctgggaagttgtgtttcaaatgagcactgtaaatgattttgctgaggcaggagaatggcgtgaacccaggaggcagagcttgcagtgagcagagatcgcgccgctgcactccagcctgggcaacagantggactccgtctcaaaaaa

SEQ ID NO: 71527 - DNA, 236 bp, Homo sapiens
ttacaaacgtcttagaaatagcctcagagcccaaagaaaaattttaaaagcacatttggccataaattacaacttactaaatgtaaacaccagaaattattcaaggtattcttcagaccacaatggaattaaactagaaatcaataaaagaaagactgctggaaaaacccaaaatattgggtgattaaacaacatccttctaaataatgttatatgtcagagatgtcttgaggaat

SEQ ID NO: 71528 - DNA, 405 bp, Homo sapiens
ctgctttctcagtgcttatcatggtctgaaaattcctatttaaagaagcagagctttcttttaagtcctaacagaacaaagtcacactcaacagtgcacaggcacacgccgggatcgagaatgcatttttggcaaaaagtctcctcttttctctgtctcctccagctctctgcaggcccaaaccttgcagaagccattccatgtttcctgagcaggaaaagacaaactcagaccgacaaccttggacttcaaaagactgcacacaaggggaggaaggactgagagtaccaaggcgtgagaattcagaatgctgctatctcatttatttttaccatttaggaaacgttttgatctgcattccttttcccttccctgatttcaaaaaataaaaataaaaatgcttcg

SEQ ID NO: 71529 - DNA, 924 bp, Homo sapiens
gatgggtaacttattttctagtagagggtgctgcctttataatatataataaccccatattttcttaccaccccctggccatgcagaactgcatcaacctctccaccatctcagaaaatatctgcatagggtctcatcggtttttttctaagtgctgtgcctcatagaacaccatggggttgatacagacaatacgtgaccctcaggaccttaccagaggacagtgcctaggaacatagtacatggagccaaggatgtttataacccactgtggttccacaagaactttaggtgacttgaaaaccttatgatccattgacatgaaagcactaacccattcatttgtgtacatgatcaacacatgtcagttccttgaggatggggactcgccttgttcactgctgtatccccagggcttagaatagtacctggtctataatagcaagctcccagtaaatatctgctgtttaatgaagtaatggtaattttgaaacactttggaaaatacctttcttgtgctttagtttttgcattttgtaaacctctgtacattaataaaaatttatgattaataatgtcttgtagaacacatttgcctcagaaactttgattatttgatgtaattcttctgaattcaagtgtgttaattaaagcagaagaaaaagcttttcttaattatttagaaaactagtgataacattcggatgttctcttggctaaccaagacttctttctagtatttatttttgaactaaatgctttaagcaaataaagcactctgggatatatttgaatgttacctaacaaccactggcacctagaataatttctcattttatagacttttcactttggacacttgaatttttctaataaaactctgaaggatactattgactacacatgttttattgtgttcccttt

SEQ ID NO: 71530 - DNA, 517 bp, Homo sapiens
tgcaaagatgcttcctgagaaaccactctaaattcaatggcctacgacaacaaataatttcttcttttaaaaattatttattattttattttttgcatcttttttattattataactttaagttctgggatacatgtgcagactgtgcaggtttgttacgtaggtatacacgtgccatggtggtttgctgcatccatcatcccatcatctaggttttaagccccacttgcgtacgtaattgtcctaatgctatccctccccttgcccaccacccccaacaggccctggtgtgtgatattcccctccctgtgttctcattgttcggctcccacttaagagtgagaacatgtggtgtttggttttctgttcctgcgttagtttgccaagaatgagggtttccagcttcatccatgtccctgcaaatgacatgaactcattctttattatggctgtatagtactccatcgtgtatatgtaccacattttctgtatccagtctatcactgatgggcatttg

SEQ ID NO: 71531 - DNA, 489 bp, Homo sapiens
aaaatagaaatcttagccagccgtcatggtgtgctcctgtagtcctagctacttgggagactgaggtgggaggatcaattgaaaccagaaggtccaggctgcagggaactgtgactgcaccactgggctccagcttgggtgaaagagcgaaaccctgcctcaaaaagaaaaataagatggatgtttctgcattaaaattagggagttgtcgtataatgtagttgcataaactagtattctgtgcttgtgtggttaaagagccttcgtagaaaaaatcccacatttttcttaaaaggaaatcttttggccaggtgtggtggctcacatctgtaagcccaacactctgggaagccgaggtgggcagatcacttgaggtcaggagtacaaaaccatcctggccaacatggtgaaaacccgtctctactaaaaatacaaagatcagctgggcatggtggtgcgtgcctgggtgacagagcgagactccgtcca

SEQ ID NO: 71532 - DNA, 442 bp, Homo sapiens
tggaagtgaaagtagcactttgaaaaagtattaagtaagttgcaaaccattctctataacctaaatgtcaccaaccaccagtcaggaagtttgtcctggtctatttcacttcctcacactggaggagaggtattggggtccccacaaagtattggaaaggcagcatgacttagaatgatgctcttaggactgagaaacaggagaccttggtatgagacttactttgcctccagtgagcaggggaaggtcacttcaccatctttatctaaaaaataaaggctttgggctctgatccacagagatgggtgagtcctaatgctctgtgactctatgcatctggtatccttttcctgtccagggctagaaatatattttgtcttttccagtcataagaaaagtgggaggagcctgggcaacataacaaaaccccatctctacaaaa

SEQ ID NO: 71533 - DNA, 2894 bp, Homo sapiens
tttttaaatcaagagtgtatttaaagttattttttcatttgtatataattttaaaccatgttttcttacagtttgtcatcatcctgctcttggtttttgtcacagaagttgttgtagtggttttgggatatgtttacagagcaaaggtatgttgtctactgtaattcacataatgccttaaaaggtggtttaagtgtttcaagtaaaatagaacacattcattttatcagagtaaacattttcttttgccttacttgtttaatctgtatttcaaatatctaaagttaattggcaaatatttacatgtcaagactccttacctcatttaatatagcagagtgttatatatgtattgttcttgattataggtatttatagctgcaaatgaataattagctgagaagtttgttcagatttcctcagcacacagattgcctatatgaggggaggcataattttctgatttctgctttagaagaaccaaactcagaattgcgttttccattgtctctttaaaaaatgctttggtcctaaacatagaaaaaggtgttgtgagttgtgatcccaccttccacccctgtcctgaggaacaaggggtcctgccaacttagaacaccaaggcagctggtgccagcactcctttcttgcccttcattctttttaatcatttcaccgttccttcctttctattttgcctgattttgctgtctacctgtagtactacttaaggctaaacaggctgctttaaattaattaatatgggtataattttagaggcatggtaaagacataatagactcattctcattataacttaatggttttgagtcaagggcataatatgccaagttaattttcagatcattgatacgtaaggtactgtaaagctgtgctaaaaaaaaaatgcaatggattatgtccctacctatgatctggttatcaattttatggacttatgatattactgttgtaattaccagataagtccagtcctccgaggggtaaggaggatctggtacaagcaaactttactaagtgatacttgcttgccattttagtaattggcagcaataagctatgaagcttgtttcctgtctcctttttgcaatacattgaacagtagctttttcataaagtgccatttctaaggactgatttttttaaacctgccgattacttttgcacatttagccaactctaaacgttgaataaataaaatggaaataatgttggcatttgtcctaaaagtatcttacaggagcttcagagttactttgttttacctcctttaggaaaggaaaatgagtaacttatttgtaaaaggaaggcatccatttataatttaggacatctatcccaagcctcaacttttctcccttttgaatacattgttagcctgccattttgcacacaatcttctctttgaatgcttgaatgtatgtggtatatgtctgaatttttacctgtcacttttctccctcctgccttcatctatatctatatgaagatgaaggcaggaagggagaaaactttacaggaaattcatagatatctggcaacttgcaaacatttcatttaagtattttagtaggagccttgactaatgttacttttactagtatttttgagggactgaattctttgttctgattcaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagttgtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttggggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaa

SEQ ID NO: 71534 - DNA, 830 bp, Homo sapiens
  misc_feature (666)..(666): n is a, c, g, or t
  misc_feature (669)..(669): n is a, c, g, or t
  misc_feature (675)..(676): n is a, c, g, or t
gttctagatcgcgagcggccccccgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttggggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaaanaanaagaanncgcaccgcaaagcaagggtggcggcaggcccagcgaaatagaaccacgtggggcggcgcccaaacgaacagaggcaagcgaaagaaacgggcggcgggggcacccaaaaagcggggggcggggaaaccagggtcgccgcggctcggggcgaaca

SEQ ID NO: 71535 - DNA, 312 bp, Homo sapiens
ggggtgactctagaggaccccggttgtagttgatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaa

SEQ ID NO: 71536 - DNA, 896 bp, Homo sapiens
cgtttttttaaaatcaaataactgaggctttacctcatcaatgagaagttagaacagcaaattatctcacaaaaaaattatattttgggagaaggtaggtcaaaaattctagaatcattttctctttaatccagcttaatccttttgcttatccaaaataacatggcatgactttattactattccaatatgctaccacagaaggtttaggacttattgaaataaaatgatgacggaagagtgacctttcaaaagtaatatgtatgtaataccacagaaccgtggatttcaaaaaatagtgaatgtgaaggaaacaaagaaaccgttccaacctacattttttttggcatcagaatttgttttctaccatagggctattcacatactgaatttcgttttccaaaaaccaaaagacctgaaaagaccactattaaacacacacattcttgctcattctactccccaggcctttgctgtccagaatggtagccactagccacatgtgtctacatttaaattaatttaaataaaattaaaagtgcaactcagttgcagtaactatatttcaggtgctcagtagtcacatgaggccacatgacagtgcatatgtggtatgtctccatcgctgcagaaagttctttcggacagcactcgctagactagtagtggggatgccaaataagagagacttgattccctgctggctttacgaagagttcctgggagggaagctgaagcttaggacttagttccttaaaaaataatgtactcataagaaattccttctatcactgttgttactgcctttttgatgatttgaagtcattgaactttgagaccagcctgggcaataagactccatttctaccaaaaaaaaaattttttttaaaaaaaaa

SEQ ID NO: 71537 - DNA, 299 bp, Homo sapiens
cctagttttagaagtttcaatagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggtgagtctcttggcca

SEQ ID NO: 71538 - DNA, 1872 bp, Homo sapiens
gttgccagggagcggcgcgggagccctgaggggactgcggcggctgcgcggaggagcgaggcgcttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagttgtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttggggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaacatattatttttcattatttgggggatatttcagttccagagcagcagtatcatgttttctttgttggtgctgtctatagttcatc

SEQ ID NO: 71539 - DNA, 1875 bp, Homo sapiens
  misc_feature (1801)..(1801): n is a, c, g, or t
  misc_feature (1804)..(1804): n is a, c, g, or t
gttgccagggagcggcgcgggagccctgaggggactgcggcggctgcgcggaggagcgaggcgcttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagttgtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttggggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaaaaaaaaacaaacacnaancccccactacacataaaccccactacacacaaaacgaggggcgcgccaaaaacatccccggcgccgccccc

SEQ ID NO: 71540 - DNA, 1821 bp, Homo sapiens
gttgccagggagcggcgcgggagccctgaggggactgcggcggctgcgcggaggagcgaggcgcttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagttgtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttggggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaaaaaaaaacacaagataataaaccattaaggaaaac

SEQ ID NO: 71541 - DNA, 1373 bp, Homo sapiens
gttgccagggagcggcgcgggagccctgaggggactgcggcggctgcgcggaggagcgaggcgcttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagttgtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcggcatgagatgttggagggcgcgatgagatgttggaagggggcatgagatgttggaaggagggatgagatgttggaaggggagatgagatgttggaagggggcataagatgttggaaggaggcatgagatgttggaagg

SEQ ID NO: 71542 - DNA, 1329 bp, Homo sapiens
  misc_feature (1193)..(1193): n is a, c, g, or t
gttgccagggagcggcgcgggagccctgaggggactgcggcggctgcgcggaggagcgaggcgcttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagttgtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgtaactgggaattctttcctgtctactgatcttctgcctaatttagtgnacgcgacggctcattccaacctggggtctgtggggggatagcggcacaccgttttccccgggtgggtgcgagaacccttctcccggactctcgttgggggagcactggtcaccccggtaatgcaccaattttttcc

SEQ ID NO: 71543 - DNA, 1095 bp, Homo sapiens
  misc_feature (1065)..(1066): n is a, c, g, or t
gttgccagggagcggcgcgggagccctgaggggactgcggcggctgcgcggaggagcgaggcgcttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagttgtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctcaacttctnnactagggtccagctcgatctctatctgtt

SEQ ID NO: 71544 - DNA, 1683 bp, Homo sapiens
ccagtgctggtaccggctgggggttatggatatcgtcgacccacggcgctcggctgcgcggaggagcgaggcgcttgctggggtcggggctgcgcgacggcgcaggggctgcggggagcgccgcgcaggccgtgcagttcctagcgaggaggcgccgccgccattgccgctctctcgggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagttgtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttggggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaa

SEQ ID NO: 71545 - DNA, 1633 bp, Homo sapiens
gttgccagggagcggcgcgggagccctgaggggactgcggcggctgcgcggaggagcgaggcgcttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacaggggtgtgaggctctagttgtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttggggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaa

SEQ ID NO: 71546 - DNA, 1109 bp, Homo sapiens
ctatgtctggccaggcgcaatggctcacgcctgtaatcccagcactttgggaggccgaggcgggcggatcacgaggtcaggacatcgagaccatcctggcccacccttccgacctctatgctgaggggtgtgaggctctagttgtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttggggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaa

SEQ ID NO: 71547 - DNA, 933 bp, Homo sapiens
caaacaccgcaatctattttagtcattttgtacctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttggggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaa

SEQ ID NO: 71548 - DNA, 912 bp, Homo sapiens
gagggacctccaacatctcatggcgtagatagaagtagaggttaaggagggtgatggggctatgagatgttccttccaacatctcatggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttggggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaa

SEQ ID NO: 71549 - DNA, 679 bp, Homo sapiens
  misc_feature (653)..(653): n is a, c, g, or t
  misc_feature (675)..(675): n is a, c, g, or t
  misc_feature (677)..(678): n is a, c, g, or t
gttgccagggagcggcgcgggagccctgaggggactgcggcggctgcgcggaggagcgaggcgcttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagcttnaatgggtatgaacacccacgananng

SEQ ID NO: 71550 - DNA, 588 bp, Homo sapiens
ccagtgctggtaccggctgggggttatggatatcgtcgacccacggcgctcggctgcgcggaggagcgaggcgcttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacggtaagatgtgttgtgagaacatgcaggagtatttagtctatgctactctccttgaacatgagactccttggctcttatagttggaacagagttaacatttaaactt

SEQ ID NO: 71551 - DNA, 482 bp, Homo sapiens
ccagtgctggtaccggctgggggttatggatatcgtcgacccacggcgctcggctgcgcggaggagcgaggcgcttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggcccatctggactttgcacccggataaatcttttaaaacgtttcctctatcacatcacttgatctgaaaataaggaaaacagaagcttcagcggtagaataaggttcaactccttcccctggtcttggagcagaagtcctcagtctggtcccaaatcaccttgcctctctgaacttgtcatttccttaaacac

SEQ ID NO: 71552 - DNA, 686 bp, Homo sapiens
tgggagggaagctgaagcttaggacttagttccttaaaaaataatgtactcataagaaattccttctatcactgttgttactgcctttttgatgatttgaagtcattgaactttgaaacagctcttttaccaacaaagaaatacacacctgccatgagagggttttcagccttttttccccattgttgttttctttcaacagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggttttt

SEQ ID NO: 71553 - DNA, 1786 bp, Homo sapiens
gttgccagggagcggcgcgggagccctgaggggactgcggcggctgcgcggaggagcgaggcgcttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagttgtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttggggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaa

SEQ ID NO: 71554 - DNA, 1796 bp, Homo sapiens
ccagtgctggtaccggctgggggttatggatatcgtcgacccacggcgctcggctgcgcggaggagcgaggcgcttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagttgtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttggggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaa

SEQ ID NO: 71555 - DNA, 2043 bp, Homo sapiens
gttgccagggagcggcgcgggagccctgaggggactgcggcggctgcgcggaggagcgaggcgcttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagttgtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttggggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaaaaaaaaaaatatccctccctccatttcatcttattccactgggtgaaatcccacccgaaaaacaatgaatttttaaattttctagttcgccctttctctcctatattccacttcctccatattctttgtgcccgtctgggcccatttaatttatttttggccacgttttttcctgggccgcatttgtgtttttttggccatatttccttatgggggtcctaaacaagtattggcccgggtttaaacaggggggaggt

SEQ ID NO: 71556 - DNA, 1952 bp, Homo sapiens
  misc_feature (1788)..(1788): n is a, c, g, or t
  misc_feature (1791)..(1791): n is a, c, g, or t
  misc_feature (1797)..(1798): n is a, c, g, or t
gttgccagggagcggcgcgggagccctgaggggactgcggcggctgcgcggaggagcgaggcgcttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagttgtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttggggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaaanaanaagaanncgcaccgcaaagcaagggtggcggcaggcccagcgaaatagaaccacgtggggcggcgcccaaacgaacagaggcaagcgaaagaaacgggcggcgggggcacccaaaaagcggggggcggggaaaccagggtcgccgcggctcggggcgaaca

SEQ ID NO: 71557 - DNA, 2332 bp, Homo sapiens
gttgccagggagcggcgcgggagccctgaggggactgcggcggctgcgcggaggagcgaggcgcttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagttgtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttggggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggtgcatataaaatttattctcccccttcaggcgagcaccacattatgtatcaccgccacacctcactttttgatgtgaagaaggaggggtcctcctaccttgttggtgtggacttcttaatataaaagacagaggaggcgagcggggcgcgtccttttaaaaacaagtccgatgcgggacggagaaaaagcgttgttgcgtgtctggtgctttctttgtcggcagaggcacacaccactcattctctgccggggggtggcgcatacttttgaggggaaacacccaccactggagatgatgattatcaccgtcggggggctacaaaaaacaagaggacagacgtgtcatggtgctgaaccaccaccgtcattcttgttgtccgcggagtaagatacatgttgctcacagagacgtattcattacgaacacaaatagcggt

SEQ ID NO: 71558 - DNA, 1750 bp, Homo sapiens
gttgccagggagcggcgcgggagccctgaggggactgcggcggctgcgcggaggagcgaggcgcttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagttgtgaagaagctacaagaaatcatgatgcatctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttggggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaa

SEQ ID NO: 71559 - DNA, 1169 bp, Homo sapiens
gttgccagggagcggcgcgggagccctgaggggactgcggcggctgcgcggaggagcgaggcgcttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagttgtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgacctatgagggatcctctagacag

SEQ ID NO: 71560 - DNA, 1638 bp, Homo sapiens
gttgccagggagcggcgcgggagccctgaggggactgcggcggctgcgcggaggagcgaggcgcttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagttgtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggtgcatataaaatttattctcccccttcaggcgagcaccacattatgtatcaccgccacacctcactttttgatgtgaagaaggaggggtcctcctaccttgttggtgtggacttcttaatataaaagacagaggaggcgagcggggcgcgtccttttaaaaacaagtccgatgcgggacggagaaaaagcgttgttgcgtgtctggtgctttctttgtcggcagaggcacacaccactcattctctgccggggggtggcgcatacttttgaggggaaacacccaccactggagatgatgattatcaccgtcggggggctacaaaaaacaagaggacagacgtgtcatggtgctgaaccaccaccgtcattcttgttgtccgcggagtaagatacatgttgctcacagagacgtattcattacgaacacaaatagcggt

SEQ ID NO: 71561 - DNA, 1233 bp, Homo sapiens
gttgccagggagcggcgcgggagccctgaggggactgcggcggctgcgcggaggagcgaggcgcttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagttgtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaa

SEQ ID NO: 71562 - DNA, 1103 bp, Homo sapiens
agattggacctctccggaagattggacctctccggaagattgtccctcttagctgctgcagagagactgccagcaattgtaatggcagcctggcccacccttccgacctctatgctgaggggtgtgaggctctagttgtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttggggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaa

SEQ ID NO: 71563 - DNA, 1219 bp, Homo sapiens
  misc_feature (13)..(13): n is a, c, g, or t
  misc_feature (15)..(15): n is a, c, g, or t
  misc_feature (22)..(22): n is a, c, g, or t
  misc_feature (51)..(51): n is a, c, g, or t
  misc_feature (63)..(64): n is a, c, g, or t
  misc_feature (87)..(87): n is a, c, g, or t
  misc_feature (89)..(89): n is a, c, g, or t
ttttcattttccncnctcgttntgtaaacatatcccacccccactactacnacttctgtgacnnaaaccaagagcaggatgatgacntncgtggcaagtccacagcgactttcccggattgtggcacagcagccaattagcccaatgatgaaaagcagggctcctacagctatgatcactacagcagggatgagcgtgtacacatcttcaaagaagtggtcatagtcatcataaggggtgtgaggctctagttgtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttggggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaa

SEQ ID NO: 71564 - DNA, 903 bp, Homo sapiens
gttgccagggagcggcgcgggagccctgaggggactgcggcggctgcgcggaggagcgaggcgcttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagttctgctgaagaaccgcactggccacccagcctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtc

SEQ ID NO: 71565 - DNA, 535 bp, Homo sapiens
ccatggaaaggggtggtaacttttaggtgttgccatcactgtggtaaactgacatggtgttgctgggtatgtctcatggagaggtgctttcactgcttccctgttcacctagtcttcaatctggtccagagtttcagccccacctctggagttgagtcctgccttctccctcaatgtgacaaatgttggccaatggtatatcgcagttgtgatgcaagcagaggcttggtaaatgcctgcatactggggtttgtcctcttggaatgctcatttgtgggagccctgaacaactatgtaagaagtctggctaccctgctggagagaacacatggtgggaagagactaaaattatgtgaagagagtcaggccagccatcccagcttctctgctgagccccgccatcagccaacctgccagctgaatgcaaccgtaagagtgatcaccagcaagatcactagaaaaaccacctaactgagcccaccctggattgaacaatcataaacaaataaaatggttattgttttaaatcacaaag

SEQ ID NO: 71566 - DNA, 500 bp, Homo sapiens
tctccctatgctgtccagactggtcttgaactcctggcttcaagcacttctcacttcagcatgatggtgcatgcctatagtcccagctacttgggaggctaaggtggaaggatcacttgaagtcaggcagttgaggttacagtgatcatgtcactgcattccagcctgggtgacgaagcaagacactgtctcttaaaaaagaaaacagtcatctacactttcttgtatatctttacaaacgacaatgttttaaaattactaatttgagtgaaccaggccccacctttcagcctccctcccttccttagacgtaagaactctgcagccacactggatggcacgaagggtcaggactgctactttgggttattacttggtaattcaaaactattttgacctctagataaatgttgtggattgcacacttgtgcaaaaaataagcatgctttaaatccaactaagatagaagaaaccagcaaattagtgatgtcaacaaactg

SEQ ID NO: 71567 - DNA, 250 bp, Homo sapiens
tataaaggatatttttaatgatgaatggaaatttcccatcatctgtttgttacctggcttgtttaatttattgttatgaggaatcttttattctatcaactatgcaaacgtgtctcaagtcatatttcctctagaggaaaagcaaagggcttgtttttcttaactgagtgataacagattactttgttaatttttagttaaaaactgtaagttaaagtaaacataaataatacaagttctgttctcaaat

SEQ ID NO: 71568 - DNA, 277 bp, Homo sapiens
cctataatcaaaaagataataacaaatgtcaatgaggaagtagagaaattagaactcccatgcactactggcaagaaggtaaatggtgcgggtgtttggagaagagcctggcagtcctcaaaaggttaagcatagttaccataggaccctgcacttccatcctaggaacctaaccaagaaaactgaaacacatgtccagaaaaactcgaacacgagtgttcacagcagcatttattattcataacagccaaaaagtagaaacagcccaaatgtctat

SEQ ID NO: 71569 - DNA, 331 bp, Homo sapiens
ttgttgtttcctaccttaaccaatacctcctggaaaaaagaggtattggtataaaaataaaccatacccaaacattcccacaacatgaccttaataagctggtgcacagtagattatggcagaggaaagaaaattgactttagaattagagaaacttaggttcaaatctcagctctgtcatgctttggttgaccttcagtaagtcccattttcttcatctgtaaaatgggaataacatctactccacagcatcattagaaagattaaatagtggctgggcatggtggctcatgcctgtaatcccagcactttgggaggctgaggtgggcgg

SEQ ID NO: 71570 - DNA, 345 bp, Homo sapiens
tatagtgtagtaaatacataaaccagtaacataatcatttattatcattatcaaatattatgtaccatacataattgtatgtgctagaattttatacgactggccgtggaggtttgttgacaccagcatcaccacaattttgtattttgttgtgctatgacctcactaggtggtaggaatttttcagctcattataatcttatgggaaccctgttatatatgtggttcattgttgaccagaatgttatggggcacatgaccgtatatatatttgtatatacatgtgtacctaaccatatattaatatatgtatgtatgaatataccatttaggtacaaatacatg

SEQ ID NO: 71571 - DNA, 2341 bp, Homo sapiens
gttcttcgaaaaacagtcaacgtccaaaaagtttattttttgagtcacctttaatagagaaatttcccactggaaacagatccacctaagtgattatctagtatcagctgtatcaaggcaaaaggtaaaggttataagatgtaaatattagaccaaaatagccttttttaacaaacacaataatgctgtacgtctgtaacaaaacaaaatttgaaaaattgaggtaatgtacacagcgatgcacacacccccacaccacaccgtgattcctgagttttgatttggttgaattcaccttgtagttccctttcctgagaaaatacaggttcaacacatctagtccacgatgtacgtacaaggggaaggggtgaacaggaaatagactcccttattctgctcacatgagctggaacctgtactagctgcatatttcatagaccccagaggctcacctcaattgtactcctatgataaaatgtctctagcatttgtcatgagagaaactggctagaaatagtttgttcattgcgtccagcaagacacgcattgctgttgatatctttgtggctaagatggagaatgtgactggataatagttatccaggtggattactagctattgaaacagtctgagatagttgcatgatgattaacgttaaactgggagtaatttcaagtcatttggctaaaaatgaaaaaaaagtcccataaaaaggtatcaaatgtacagataatagggctggaattattaagtatgatgatgttattaacatctaaaattattttggccgggcaaggtgggtcacgcctgtaatctcagcactttgggatgccaagatgggtggatcacctgagttcaggagttcaagaccagcttggccaacatggcgaaacccgtctctactaaagaatacaaaaattagccaggtgttgtggcacatgcctgtactcccagctactcaggaggctgaggcagaagaatcatttgaaccccggaggtggaggttgcagtgagccgacattgtgccgcttcattccagcctgggcaacagagtgaaactcttgtctcaaaagtaaaaaaataataatgtttaaaaatatttcaatgtggagacaagctcaaaatgaaattagacacattccattacccaggtaaaagaaggggaagcctgacttgatagtagtattcaggaaaaaagagttggcagttttatttggccaaattccaatatcagctcatggtacagcacaccgggggagggggacgggaggcgagaactaaggctttttaagaatgtgttgatggaagtatgtgcctagatcaaaagaataatccccccggactccagtgtaagatcaattactgttggaatattgtgttcctttctagatatcacattttaagcagactttggccaagtagtacagtgtttgcaggagcagtaacaagatggtgataactttgaaaatacttctcaaaagaaaaataaaaaagaattagggaagttcagtctggagataattcagaaatacagatgataattgttttcaaattcttgaaggaaatgggagagagaataggctaattctgtattgcttcagaaaccaaatggaaacaattaaattccattagagaaatggttggaaaatatgaggaggatttagttcagtacgaggaagctgtttctaatactttttgttggttaaaaatacattccgctgctgtggaaagcctgtagctgccaggagtgttacagagggcattcctcccttgagttgacatttgtgccaaaccggctttgagggcttctccagcttttaagatgcgataatgataagatgatcatcgggaaaacatccctcagatgaaacgttcacaggctggctctgaaaactggcattcagatgattgcggctcccccatactgtaggaatattgtttatggcttaaggttgcctcgctcctcatctgtaatcagtgaaagtttatccagaggttaattaccggttttctggtgggtatctgggaactgaggatgggagattaactgttgtatatgaccatagtaaagcaaaagactgttagagaatgagtaaacgttcgttttcctccctacagaatttacagttactctctgtccattccactcactactgtcttcatcacacacacagaggcaaacgtctgattcagatagccaggtgtgccatgcatgcactccaccatattgtgatctcttcgaggcttgtttctgtcccctgtcctccacagtcctggattgttaatgaatagttcatacatgtttgttaaataaatataccttctttaaaattaaaaatt

SEQ ID NO: 71572 - DNA, 387 bp, Homo sapiens
tgccatgtaagcagtgcagagtgccacaggagtcactggtcagtcgcttccaccaaccgtttccttttgcagatactgcctgggtctgaacctgattaaagttctacattataggcttcctactccaaatcctaatgtttattctaactagtatcagtctgtttcagtcaaaatacaaactataacaatgaacacgctattttagaaatgtagccaaaatccttacttatgatctatgattatgtttcttttaaattttaaatgtattcctaggagtgaacgaaagcgtttcttcatagtgttttatggtcaccattagagcccaaatcctgctttccctatagcaactgggtggttgtgtttttattaatctattaatttatttta

SEQ ID NO: 71573 - DNA, 813 bp, Homo sapiens
aaaaacatgactctgcaaaagaaactggttcaagaacatgaatgggaagagaaaaaacagaagctatcagcaacagaggaagtgaaaacttacaagcagaaaattcattcaatgaagaatgaattacagaaaacagagagagacgacaaaaccagattgctcttcaggattagaaaattcaggacaattggtactattcatgcttcagaaagagttcttgctaactttcaaaaatagatgcaagctgtcagcctgagatagaattagtaaaaatttgccatcatggtaattatttaaaaaccagtgactataaacccaactccagacagaccccgttcatcaaataacaaaggcaagcctcctaaaccacgccagttcttttggcccatgactaatattgtttgaacgctctattcctcactaatgatgtatccacttgaaaaggctcttctctaaatttagaaatgtacctagaaggaaacatatgccactccatgggccctcacatgatcgtgagggtgggtggttattggaagtagctggaatacccttccctggctcatcgggtgaattaccaaaacccgtcaattctacccctagtacttagatctgttcactcttctccactcctaagagtataatatttcaaggttgagtttaaacgtaatctttcttgatactccaagaagagatttttttcacaaggatgttatttgtctttgaaaatatttttaccttttataaacgtttgcaataaacaacgatgcgaaagtttcttatttttggatatccatatctataatcccttcctac

SEQ ID NO: 71574 - DNA, 490 bp, Homo sapiens
gatcatcccgcctcagcctcccaaagtgctgggattacaggcgtgagccaccgtgcccggtggatctttccagtatttaggatcccattccttaagtggggctgggaaagaggggatgtaggaatggggaggaatctgacttcaacaattgatgtgggtttgagaaccttggatccaccccctaagtactgacatgcaaagaaacagcatgaaaaggaaaaaacatttaagggttgctggacctcagtgaaaaggcagaggtttatatggtttgtaatacatgaggagcttcacatttcctctttcaaagaagaggaaaacagtagcattttgtgtgtgtgtgtgtgtctgtttatttggaagagttgattctcagtcattgatactaaatgtaaattccagaagttcaaatgacaatatctggtgactcctttacaaaccataggacaggagtaggcacctgtcagaaataaggcaagttttaactttt

SEQ ID NO: 71575 - DNA, 373 bp, Homo sapiens
aaacttctcagccatagtgccaaagaacattatcagacccaattccctatatcccaacaaaaccactccccagtcacagattatccgacacaatttcattggggttctcaaatggcaagagtttgtttaaaatgcaaatctctgagccccaccctcagagaggccagcggggcagtggaatatgcactgaacacttcgggcactaactcgtgtgccaatggttgcacttggacatatactactctaggcctttgggctcctttcgtccctgcagcaccttctgtcctcaagacaggggctctcttgttttcctcatgcgagagctgttgcccagctagtccatcccactgaggacaaactctgactcaccttt

SEQ ID NO: 71576 - DNA, 276 bp, Homo sapiens
acacattatcacatttttgtaatccacctatgatctgaaacaatattcatgagtctcttcattgcttttcttaatattaccttcataatacatcattcttagccagattgctaggtatttcctcacaagtttttctaattatttcatgaagagtgcgtttttccttcattttcaagaatatttcaagattagctaatgttagtaattatatatgaaaatatatacatataaggcatctaaaataatgattaatatttttatgtgcataaaagcatg

SEQ ID NO: 71577 - DNA, 3793 bp, Homo sapiens
tagaaaagataaattctttatttgtggaaaacaacagaagtggggctatttaggcaccgccaatgtttattatattcatatggcagagaataaacacagcacactagaagtttgcgctttgggtattaaaaaaaaaaaaaagcaaaaccttcttaggtcactgactatcttcttttgctcctttctatctgactcctcaggcaaggtgcaattcaaatccctggagaacctctcaaatatagctgctgttcaatgttactcagaaataaggaaagaaatttgacacggagacactccacatcttggctgcctggaaaaatatcatctttgaggtcattcaactcactaagtcatttttattattgttttgtctgtctattttctggtacagtctcaatgaaagatatgtggccctaatcatgcaaaaccgatctggggggaatcagttgtttcttcaggtcttcgcaggattccagctcccccaactacctccgtcgccttctaaaactggcaggctctggacgttttgcatgctgaagaaaatcactgttttgcctccagcaaggaacataaatgttgcaacactgactcctcctctcatgaagaaagagtgaacaagtgcaccgagttgagcttcttctcacagagccaccgggctggggaccggggagcggaggctgaaatccccagacgccggttttctgggctgggctttctgccttactcactccttctccctctttctggattttaccgaccgttcgcgaaacagctttccacacaatggagcttcatgtcctcgtgcaggaagtactcatcgactgatgtggcagactttgctccctggcaaaactaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaaggtatgaaacccacatacctggatcctgacactgactcaggccgggggagctgtgacagcccttcccttttgtctgaaaagtgtgaggaaccccaggccaatccctccacattctatgatcctgaggtcattgagaagccagagaatcctgaaacaacccacacctgggacccccagtgcataagcatggaaggcaaaatcccctattttcatgctggtggatccaaatgttcaacatggcccttaccacagcccagccagcacaaccccagatcctcttaccacaatattactgatgtgtgtgagctggctgtgggccctgcaggtgcaccggccactctgttgaatgaagcaggtaaagatgctttaaaatcctctcaaaccattaagtctagagaagagggaaaggcaacccagcagagggaggtagaaagcttccattctgagactgaccaggatacgccctggctgctgccccaggagaaaaccccctttggctccgctaaacccttggattatgtggagattcacaaggtcaacaaagatggtgcattatcattgctaccaaaacagagagagaacagcggcaagcccaagaagcccgggactcctgagaacaataaggagtatgccaaggtgtccggggtcatggataacaacatcctggtgttggtgccagatccacatgctaaaaacgtggcttgctttgaagaatcagccaaagaggccccaccatcacttgaacagaatcaagctgagaaagccctggccaacttcactgcaacatcaagcaagtgcaggctccagctgggtggtttggattacctggatcccgcatgttttacacactcctttcactgatagcttgactaatggaatgattggttaaaatgtgatttttcttcaggtaacactacagagtacgtgaaatgctcaagaatgtagtcagactgacactactaaagctcccagctcctttcatgctccatttttaaccacttgcctctttctccagcagctgattccagaacaaatcattatgtttcctaactgtgatttgtagatttactttttgctgttagttataaaactatgtgttcaatgaaataaaagcacactgcttagtattcttgagggacaatgccaataggtatatcctctggaaaaggctttcatgatttggcatgggacagacggaaatgaaattgtcaaaattgtttaccatagaaagatgacaaaagaaaattttccacataggaaaatgccatgaaaattgcttttgaaaaacaactgcataacctttacactcctcgtccattttattaggattacccaaatataaccatttaaagaaagaatgcattccagaacaaattgtttacataagttcctataccttactgacacattgctgatatgcaagtaagaaataatgcctccaattttttcttaaaatagtttagatatgttaagcatggattttccccctaaattctactctaaagcttctataaaatatagtttggaaataaaaatgttcttacacaaggggcaaatgaatttcatgtgaatccctttaggatgttttcctccttcatttcagcatgatagataatttattatacaccttagtctttccttagttaaaaaaaaattccctaaagactaacttgaaaagaaaaccacagcaggatgctaatggaattactgccttactgtacatacaaattctactttaatataaacccataagtttaactgtatttttgaagactatttttctatgacttaggtaaaataaaagactattttctattttaaaaataca

SEQ ID NO: 71578 - DNA, 216 bp, Homo sapiens
gatggaagaagaatacttgaggccctaaaataacctttccaacatgctcttccctctctcactcccagctgaaatgggcagaacatggaagcctaaggaaccatttgtcagctctgggttttgcgcttggaatttctgatacccaaaggccagtggtattgatctatgaagaaaaaaactagactctctttattactttcttattcattcctaata

SEQ ID NO: 71579 - DNA, 3490 bp, Homo sapiens
tagaaaagataaattctttatttgtggaaaacaacagaagtggggctatttaggcaccgccaatgtttattatattcatatggcagagaataaacacagcacactagaagtttgcgctttgggtattaaaaaaaaaaaaaagcaaaaccttcttaggtcactgactatcttcttttgctcctttctatctgactcctcaggcaaggtgcaattcaaatccctggagaacctctcaaatatagctgctgttcaatgttactcagaaataaggaaagaaatttgacacggagacactccacatcttggctgcctggaaaaatatcatctttgaggtcattcaactcactaagtcatttttattattgttttgtctgtctattttctggtacagtctcaatgaaagatatgtggccctaatcatgcaaaaccgatctggggggaatcagttgtttcttcaggtcttcgcaggattccagctcccccaactacctccgtcgccttctaaaactggcaggctctggacgttttgcatgctgaagaaaatcactgttttgcctccagcaaggaacataaatgttgcaacactgactcctcctctcatgaagaaagagtgaacaagtgcaccgagttgagcttcttctcacagagccaccgggctggggaccggggagcggaggctgaaatccccagacgccggttttctgggctgggctttctgccttactcactccttctccctctttctggattttaccgaccgttcgcgaaacagctttccacacaatggagcttcatgtcctcgtgcaggaagtactcatcgactgatgtggcagactttgctccctggcaaaactaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatgttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaaggtatgaaacccacatacctggatcctgacactgactcaggccgggggagctgtgacagcccttcccttttgtctgaaaagtgtgaggaaccccaggccaatccctccacattctatgatcctgaggtcattgagaagccagagaatcctgaaacaacccacacctgggacccccagtgcataagcatggaaggcaaaatcccctattttcatgctggtggatccaaatgttcaacatggcccttaccacagcccagccagcacaaccccagatcctcttaccacaatattactgatgtgtgtgagctggctgtgggccctgcaggtgcaccggccactctgttgaatgaagcaggtaaagatgctttaaaatcctctcaaaccattaagtctagagaagagggaaaggcaacccagcagagggaggtagaaagcttccattctgagactgaccaggatacgccctggctgctgccccaggagaaaaccccctttggctccgctaaacccttggattatgtggagattcacaaggtcaacaaagatggtgcattatcattgctaccaaaacagagagagaacagcggcaagcccaagaagcccgggactcctgagaacaataaggagtatgccaaggtgtccggggtcatggataacaacatcctggtgttggtgccagatccacatgctaaaaacgtggcttgctttgaagaatcagccaaagaggccccaccatcacttgaacagaatcaagctgagaaagccctggccaacttcactgcaacatcaagcaagtgcaggctccagctgggtggtttggattacctggatcccgcatgttttacacactcctttcactgatagcttgactaatggaatgattggttaaaatgtgatttttcttcaggtaacactacagagtacgtgaaatgctcaagaatgtagtcagactgacactactaaagctcccagctcctttcatgctccatttttaaccacttgcctctttctccagcagctgattccagaacaaatcattatgtttcctaactgtgatttgtagatttactttttgctgttagttataaaactatgtgttcaatgaaataaaagcacactgcttagtattcttgagggacaatgccaataggtatatcctctggaaaaggctttcatgatttggcatgggacagacggaaatgaaattgtcaaaattgtttaccatagaaagatgacaaaagaaaattttccacataggaaaatgccatgaaaattgcttttgaaaaacaactgcataacctttacactcctcgtccattttattaggattacccaaatataaccatttaaagaaagaatgcattccagaacaaattgtttacataagttcctataccttactgacacattgctgatatgcaagtaagaaataatgcctccaattttttcttaaaatagtttagatatgttaagcatggattttccccctaaattctactctaaagcttctataaaatatagtttggaaataaaaatgttcttacacaaggggcaaatgaatttcatgtgaatccctttaggatgttttcctccttcatttcagcatgatagataatttattatacaccttagtctttccttagttaaaaaaaaattccctaaagactaacttgaaaagaaaaccacagcaggatgctaatggaattactgccttactgtacatacaaattctactttaatataaacccataagtttaactgtatttttgaagactatttttctatgacttaggtaaaataaaagactattttctattttaaaaataca

SEQ ID NO: 71580 - DNA, 2975 bp, Homo sapiens
tagaaaagataaattctttatttgtggaaaacaacagaagtggggctatttaggcaccgccaatgtttattatattcatatggcagagaataaacacagcacactagaagtttgcgctttgggtattaaaaaaaaaaaaaagcaaaaccttcttaggtcactgactatcttcttttgctcctttctatctgactcctcaggcaaggtgcaattcaaatccctggagaacctctcaaatatagctgctgttcaatgttactcagaaataaggaaagaaatttgacacggagacactccacatcttggctgcctggaaaaatatcatctttgaggtcattcaactcactaagtcatttttattattgttttgtctgtctattttctggtacagtctcaatgaaagatatgtggccctaatcatgcaaaaccgatctggggggaatcagttgtttcttcaggtcttcgcaggattccagctcccccaactacctccgtcgccttctaaaactggcaggctctggacgttttgcatgctgaagaaaatcactgttttgcctccagcaaggaacataaatgttgcaacactgactcctcctctcatgaagaaagagtgaacaagtgcaccgagttgagcttcttctcacagagccaccgggctggggaccggggagcggaggctgaaatccccagacgccggttttctgggctgggctttctgccttactcactccttctccctctttctggattttaccgaccgttcgcgaaacagctttccacacaatggagcttcatgtcctcgtgcaggaagtactcatcgactgatgtggcagactttgctccctggcaaaactaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatgttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaaggtatgaaacccacatacctggatcctgacactgactcaggccgggggagctgtgacagcccttcccttttgtctgaaaagtgtgaggaaccccaggccaatccctccacattctatgatcctgaggtcattgagaagccagagaatcctgaaacaacccacacctgggacccccagtgcataagcatggaaggcaaaatcccctattttcatgctggtggatccaaatgttcaacatggcccttaccacagcccagccagcacaaccccagatcctcttaccacaatattactgatgtgtgtgagctggctgtgggccctgcaggtgcaccggccactctgttgaatgaagcaggtaaagatgctttaaaatcctctcaaaccattaagtctagagaagagggaaaggcaacccagcagagggaggtagaaagcttccattctgagactgaccaggatacgccctggctgctgccccaggagaaaaccccctttggctccgctaaacccttggattatgtggagattcacaaggtcaacaaagatggtgcattatcattgctaccaaaacagagagagaacagcggcaagcccaagaagcccgggactcctgagaacaataaggagtatgccaaggtgtccggggtcatggataacaacatcctggtgttggtgccagatccacatgctaaaaacgtggcttgctttgaagaatcagccaaagaggccccaccatcacttgaacagaatcaagctgagaaagccctggccaacttcactgcaacatcaagcaagtgcaggctccagctgggtggtttggattacctggatcccgcatgttttacacactcctttcactgatagcttgactaatggaatgattggttaaaatgtgatttttcttcaggtaacactacagagtacgtgaaatgctcaagaatgtagtcagactgacactactaaagctcccagctcctttcatgctccatttttaaccacttgcctctttctccagcagctgattccagaacaaatcattatgtttcctaactgtgatttgtagatttactttttgctgttagttataaaactatgtgttcaatgaaataaaagcacactgcttagtattcttgagggacaatgccaataggtatatcctctggaaaaggctttcatgatttggcatgggacagacggaaatgaaattgtcaaaattgtttaccatagaaagatgacaaaagaaaatttaaaataatacatatagggctgcatacataaaacacatatgtaccgtattgtactttatgtatcat

SEQ ID NO: 71581 - DNA, 3693 bp, Homo sapiens
tagaaaagataaattctttatttgtggaaaacaacagaagtggggctatttaggcaccgccaatgtttattatattcatatggcagagaataaacacagcacactagaagtttgcgctttgggtattaaaaaaaaaaaaaagcaaaaccttcttaggtcactgactatcttcttttgctcctttctatctgactcctcaggcaaggtgcaattcaaatccctggagaacctctcaaatatagctgctgttcaatgttactcagaaataaggaaagaaatttgacacggagacactccacatcttggctgcctggaaaaatatcatctttgaggtcattcaactcactaagtcatttttattattgttttgtctgtctattttctggtacagtctcaatgaaagatatgtggccctaatcatgcaaaaccgatctggggggaatcagttgtttcttcaggtcttcgcaggattccagctcccccaactacctccgtcgccttctaaaactggcaggctctggacgttttgcatgctgaagaaaatcactgttttgcctccagcaaggaacataaatgttgcaacactgactcctcctctcatgaagaaagagtgaacaagtgcaccgagttgagcttcttctcacagagccaccgggctggggaccggggagcggaggctgaaatccccagacgccggttttctgggctgggctttctgccttactcactccttctccctctttctggattttaccgaccgttcgcgaaacagctttccacacaatggagcttcatgtcctcgtgcaggaagtactcatcgactgatgtggcagactttgctccctggcaaaactaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgcatggtgacctgcatctttccgccagttcctgggccaaaaataaaaggatttgatgctcatctgttggagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaaggtatgaaacccacatacctggatcctgacactgactcaggccgggggagctgtgacagcccttcccttttgtctgaaaagtgtgaggaaccccaggccaatccctccacattctatgatcctgaggtcattgagaagccagagaatcctgaaacaacccacacctgggacccccagtgcataagcatggaaggcaaaatcccctattttcatgctggtggatccaaatgttcaacatggcccttaccacagcccagccagcacaaccccagatcctcttaccacaatattactgatgtgtgtgagctggctgtgggccctgcaggtgcaccggccactctgttgaatgaagcaggtaaagatgctttaaaatcctctcaaaccattaagtctagagaagagggaaaggcaacccagcagagggaggtagaaagcttccattctgagactgaccaggatacgccctggctgctgccccaggagaaaaccccctttggctccgctaaacccttggattatgtggagattcacaaggtcaacaaagatggtgcattatcattgctaccaaaacagagagagaacagcggcaagcccaagaagcccgggactcctgagaacaataaggagtatgccaaggtgtccggggtcatggataacaacatcctggtgttggtgccagatccacatgctaaaaacgtggcttgctttgaagaatcagccaaagaggccccaccatcacttgaacagaatcaagctgagaaagccctggccaacttcactgcaacatcaagcaagtgcaggctccagctgggtggtttggattacctggatcccgcatgttttacacactcctttcactgatagcttgactaatggaatgattggttaaaatgtgatttttcttcaggtaacactacagagtacgtgaaatgctcaagaatgtagtcagactgacactactaaagctcccagctcctttcatgctccatttttaaccacttgcctctttctccagcagctgattccagaacaaatcattatgtttcctaactgtgatttgtagatttactttttgctgttagttataaaactatgtgttcaatgaaataaaagcacactgcttagtattcttgagggacaatgccaataggtatatcctctggaaaaggctttcatgatttggcatgggacagacggaaatgaaattgtcaaaattgtttaccatagaaagatgacaaaagaaaattttccacataggaaaatgccatgaaaattgcttttgaaaaacaactgcataacctttacactcctcgtccattttattaggattacccaaatataaccatttaaagaaagaatgcattccagaacaaattgtttacataagttcctataccttactgacacattgctgatatgcaagtaagaaataatgcctccaattttttcttaaaatagtttagatatgttaagcatggattttccccctaaattctactctaaagcttctataaaatatagtttggaaataaaaatgttcttacacaaggggcaaatgaatttcatgtgaatccctttaggatgttttcctccttcatttcagcatgatagataatttattatacaccttagtctttccttagttaaaaaaaaattccctaaagactaacttgaaaagaaaaccacagcaggatgctaatggaattactgccttactgtacatacaaattctactttaatataaacccataagtttaactgtatttttgaagactatttttctatgacttaggtaaaataaaagactattttctattttaaaaataca

SEQ ID NO: 71582 - DNA, 758 bp, Homo sapiens
gaggcaacccaatgggcatgacctgggtatggtggtgcctgggccattgaaagctcgagtgtttatcagcagggaatataggtccccgagcccacaagaacacttatagaaaggaagggttgatggaagaagaatacttgaggccctaaaataacctttccaacatgctcttccctctctcactcccagctgaaatgggcagaacatggaagcctaaggaaccatttgtcagctctgggttttgcgcttggaatttctgatacccaaaggccagtggtattgatctatgaagaaaaaaactagactctctttattactttcttattcattcctaatacattacttattgcagagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacataggtaaggggaaggaaagtgggtgaggaatttcttactccactatgtattagccaatagtcacactcagtttgagtcttcttgggttttggatggatccccaaaaagaaagatgagaaaactcacgatatgcttgtcaacagaacagttcaaatcattttttatcaagtcattcatgacactaaggctggcacttgggatccttgtgttcctgtgctttcccttgaccctcatcctct

SEQ ID NO: 71583 - DNA, 356 bp, Homo sapiens
cttgaactctctaccttgtcatctgaggacctctggtggtggaaattttcccagcgtgtgtgaattgatgtttctgtgccaagccatccaaccctgttacattttcctacattcctttcctcctattttgtcattcacattaagcaaggagcaacaatcagttgcaaatacccagaataaagtggtggatgtgcctgaccagactgccatttcacaaaagttacctgctaccttctcttccagtgaacttctgatacatttcctgcagcaagagaaggcagccaacatgaaggaaaatgtggcatctgcaaccgttttcactctgctactttttctcaacacctgccttctgaatg

SEQ ID NO: 71584 - DNA, 1411 bp, Homo sapiens
tagaaaagataaattctttatttgtggaaaacaacagaagtggggctatttaggcaccgccaatgtttattatattcatatggcagagaataaacacagcacactagaagtttgcgctttgggtattaaaaaaaaaaaaaagcaaaaccttcttaggtcactgactatcttcttttgctcctttctatctgactcctcaggcaaggtgcaattcaaatccctggagaacctctcaaatatagctgctgttcaatgttactcagaaataaggaaagaaatttgacacggagacactccacatcttggctgcctggaaaaatatcatctttgaggtcattcaactcactaagtcatttttattattgttttgtctgtctattttctggtacagtctcaatgaaagatatgtggccctaatcatgcaaaaccgatctggggggaatcagttgtttcttcaggtcttcgcaggattccagctcccccaactacctccgtcgccttctaaaactggcaggctctggacgttttgcatgctgaagaaaatcactgttttgcctccagcaaggaacataaatgttgcaacactgactcctcctctcatgaagaaagagtgaacaagtgcaccgagttgagcttcttctcacagagccaccgggctggggaccggggagcggaggctgaaatccccagacgccggttttctgggctgggctttctgccttactcactccttctccctctttctggattttaccgaccgttcgcgaaacagctttccacacaatggagcttcatgtcctcgtgcaggaagtactcatcgactgatgtggcagactttgctccctggcaaaagtgagtacccatggcgagctgaggccgcctccgacggcgcgcggcaggggctgcgcgggcggccgctctccgggatgcgggttcgaggcccgcgtgctgaaggggagagcggggccaccggcgcgggctcctggagagaacgccagccaggagccagagtcggcagccggcggggaagcccgggatccgcccgcctcccgcccggatgtcccttctcagaggggctaaaaaatactcttaaggtgctttgcctccaccactgcccccaaccccagcttttacaaactgcactcggctcgcattcgcctttgtcaaaggcatcttcacctgtatccttgagcatgagtttcggcgttgattgtgggattctcagaatgcaaattatttgcgtcaaaataaaaagaaaagaaaaaaagagcggggagggggaaggggcgcagacaggtgatgtgatgaaagccggactcgagactctcccatcagcagcagccgccgccgcagcagcctcgcgggcatccggcggggaaagtttagggttagcaatgctgacctgaaaggt

SEQ ID NO: 71585 - DNA, 3221 bp, Homo sapiens
tagaaaagataaattctttatttgtggaaaacaacagaagtggggctatttaggcaccgccaatgtttattatattcatatggcagagaataaacacagcacactagaagtttgcgctttgggtattaaaaaaaaaaaaaagcaaaaccttcttaggtcactgactatcttcttttgctcctttctatctgactcctcaggcaaggtgcaattcaaatccctggagaacctctcaaatatagctgctgttcaatgttactcagaaataaggaaagaaatttgacacggagacactccacatcttggctgcctggaaaaatatcatctttgaggtcattcaactcactaagtcatttttattattgttttgtctgtctattttctggtacagtctcaatgaaagatatgtggccctaatcatgcaaaaccgatctggggggaatcagttgtttcttcaggtcttcgcaggattccagctcccccaactacctccgtcgccttctaaaactggcaggctctggacgttttgcatgctgaagaaaatcactgttttgcctccagcaaggaacataaatgttgcaacactgactcctcctctcatgaagaaagagtgaacaagtgcaccgagttgagcttcttctcacagagccaccgggctggggaccggggagcggaggctgaaatccccagacgccggttttctgggctgggctttctgccttactcactccttctccctctttctggattttaccgaccgttcgcgaaacagctttccacacaatggagcttcatgtcctcgtgcaggaagtactcatcgactgatgtggcagactttgctccctggcaaaactaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaagagagagaacagcggcaagcccaagaagcccgggactcctgagaacaataaggagtatgccaaggtgtccggggtcatggataacaacatcctggtgttggtgccagatccacatgctaaaaacgtggcttgctttgaagaatcagccaaagaggccccaccatcacttgaacagaatcaagctgagaaagccctggccaacttcactgcaacatcaagcaagtgcaggctccagctgggtggtttggattacctggatcccgcatgttttacacactcctttcactgatagcttgactaatggaatgattggttaaaatgtgatttttcttcaggtaacactacagagtacgtgaaatgctcaagaatgtagtcagactgacactactaaagctcccagctcctttcatgctccatttttaaccacttgcctctttctccagcagctgattccagaacaaatcattatgtttcctaactgtgatttgtagatttactttttgctgttagttataaaactatgtgttcaatgaaataaaagcacactgcttagtattcttgagggacaatgccaataggtatatcctctggaaaaggctttcatgatttggcatgggacagacggaaatgaaattgtcaaaattgtttaccatagaaagatgacaaaagaaaattttccacataggaaaatgccatgaaaattgcttttgaaaaacaactgcataacctttacactcctcgtccattttattaggattacccaaatataaccatttaaagaaagaatgcattccagaacaaattgtttacataagttcctataccttactgacacattgctgatatgcaagtaagaaataatgcctccaattttttcttaaaatagtttagatatgttaagcatggattttccccctaaattctactctaaagcttctataaaatatagtttggaaataaaaatgttcttacacaaggggcaaatgaatttcatgtgaatccctttaggatgttttcctccttcatttcagcatgatagataatttattatacaccttagtctttccttagttaaaaaaaaattccctaaagactaacttgaaaagaaaaccacagcaggatgctaatggaattactgccttactgtacatacaaattctactttaatataaacccataagtttaactgtatttttgaagactatttttctatgacttaggtaaaataaaagactattttctattttaaaaataca

SEQ ID NO: 71586 - DNA, 2897 bp, Homo sapiens
tagaaaagataaattctttatttgtggaaaacaacagaagtggggctatttaggcaccgccaatgtttattatattcatatggcagagaataaacacagcacactagaagtttgcgctttgggtattaaaaaaaaaaaaaagcaaaaccttcttaggtcactgactatcttcttttgctcctttctatctgactcctcaggcaaggtgcaattcaaatccctggagaacctctcaaatatagctgctgttcaatgttactcagaaataaggaaagaaatttgacacggagacactccacatcttggctgcctggaaaaatatcatctttgaggtcattcaactcactaagtcatttttattattgttttgtctgtctattttctggtacagtctcaatgaaagatatgtggccctaatcatgcaaaaccgatctggggggaatcagttgtttcttcaggtcttcgcaggattccagctcccccaactacctccgtcgccttctaaaactggcaggctctggacgttttgcatgctgaagaaaatcactgttttgcctccagcaaggaacataaatgttgcaacactgactcctcctctcatgaagaaagagtgaacaagtgcaccgagttgagcttcttctcacagagccaccgggctggggaccggggagcggaggctgaaatccccagacgccggttttctgggctgggctttctgccttactcactccttctccctctttctggattttaccgaccgttcgcgaaacagctttccacacaatggagcttcatgtcctcgtgcaggaagtactcatcgactgatgtggcagactttgctccctggcaaaactaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgcatggtgacctgcatctttccgccagttcctgggccaaaaataaaaggatttgatgctcatctgttggagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaaggtatgaaacccacatacctggatcctgacactgactcaggccgggggagctgtgacagcccttcccttttgtctgaaaagtgtgaggaaccccaggccaatccctccacattctatgatcctgaggtcattgagaagccagagaatcctgaaacaacccacacctgggacccccactcctttcatgctccatttttaaccacttgcctctttctccagcagctgattccagaacaaatcattatgtttcctaactgtgatttgtagatttactttttgctgttagttataaaactatgtgttcaatgaaataaaagcacactgcttagtattcttgagggacaatgccaataggtatatcctctggaaaaggctttcatgatttggcatgggacagacggaaatgaaattgtcaaaattgtttaccatagaaagatgacaaaagaaaattttccacataggaaaatgccatgaaaattgcttttgaaaaacaactgcataacctttacactcctcgtccattttattaggattacccaaatataaccatttaaagaaagaatgcattccagaacaaattgtttacataagttcctataccttactgacacattgctgatatgcaagtaagaaataatgcctccaattttttcttaaaatagtttagatatgttaagcatggattttccccctaaattctactctaaagcttctataaaatatagtttggaaataaaaatgttcttacacaaggggcaaatgaatttcatgtgaatccctttaggatgttttcctccttcatttcagcatgatagataatttattatacaccttagtctttccttagttaaaaaaaaattccctaaagactaacttgaaaagaaaaccacagcaggatgctaatggaattactgccttactgtacatacaaattctactttaatataaacccataagtttaactgtatttttgaagactatttttctatgacttaggtaaaataaaagactattttctattttaaaaataca

SEQ ID NO: 71587 - DNA, 465 bp, Homo sapiens
ctctgactctactaaaaaaatacaaaaatgtgccaggtgtggtggtatactcttgtaattccagctactcaggaggctgaggtgggaggatcacttgaacccgggaggtcctagaagttgcagtgagccaagatcacgccactgtactccagccttggtgacagagcaagactccatctcaaaaaaaaaaaaaaaaaaaggctgggcgtagtggctcacacttgtaaatgggaggcagaggcaggccgatcacgaggtcaggagttcgagaccagcctggccaacatcgtgaaaccccatctctactaaaaatacaaaaaattatccgggtgtggtggcgggcacctgtaatcccagctactcaggaggctgaggcaggagaatcgcttgaatccgcgaggcagaggttgcagtgacccgagatcaccaccattccattgcactctagctcgggcgggcgtcaaa

SEQ ID NO: 71588 - DNA, 1482 bp, Homo sapiens
gttacataagaacaaaaacctatgaatgtaatatatgtgaaaaaatcttcaaacaacctattcaccttactgaacatatgagaattcatactggtgagaaacctttcagatgtaaggaatgtggaagggcctttagtcaaagtgcatccctcagtacacaccagagaatccatactggtgagaaaccctttgaatgtgaggaatgtgggaaagccttcagacatcgctcatcacttaatcagcatcatagaactcacactggggagaaaccctatgtatgtgataaatgtcagaaagctttcagccagaacattagcttggttcaacatttgaggactcattctggagagaaaccttttacttgcaatgaatgtgggaaaacctttagacagattagacaccttagtgaacatataagaattcataccggggagaagccctatgcatgcactgcatgttgtaaaacctttagtcatagagcgtatctaacacatcaccagagaatccatactggggagagaccctacaaatgtaaagaatgtggaaaagcctttaggcagaggatacaccttagcaaccataaaactgttcatacaggagtgaaagcatatgaatgcaaccgctgtggaaaagcctataggcatgattcatcctttaaaaaacatcagagacatcacactggagaaaaaccttacgaatgtaacgaatgtggaaaagccttcagctataactcttcacttagtcgacatcatgaaatacacaggaggaacgccttccgaaataaggtgtaaaaacagatatttgacttgagaacaaaagccaagtgtaaattggtgatttagagtgctttaaaatttcaggactcagatatgaggaattgatgtaatgatgccaacttttaatttttcccattgtaaataaacattacattgacaggtattgactactaacacctctaaaaagtacttaagattaaaatctggtccttaaaattaaatgaattcagcattatgaaaaattcataacagtttttttctgatttcatggtggattaataaattattcttcatgggtattcatgatttgcagaccagcatttgggaactatagcttaaaatatcaccaaccgtattttttaaattaaaattttatttttttggccaggcatagtggcttgtgcctgtaattgggaggtcaaggaaggaggatcacttgccagaagtcaagaccagcctggacaacatagcaagacccatctctgcaaaaaagtttttaaaaaattagccaggcatggtagcatgcgcctgtagtcctagctgtgcagaaggctgaagcagaaggatcacctgagcccaggagttcaaggttgcaatgagctgtgatcaccactgcatttcagggtctcactctgttgctcaggctggagtgcagttggtatgatcatggttcactgcagcctcaatctcccaggctcaagcaaac

SEQ ID NO: 71589 - DNA, 1787 bp, Homo sapiens
  misc_feature (257)..(257): n is a, c, g, or t
  misc_feature (305)..(305): n is a, c, g, or t
  misc_feature (325)..(325): n is a, c, g, or t
  misc_feature (381)..(381): n is a, c, g, or t
  misc_feature (407)..(407): n is a, c, g, or t
  misc_feature (630)..(630): n is a, c, g, or t
  misc_feature (633)..(633): n is a, c, g, or t
  misc_feature (770)..(771): n is a, c, g, or t
ccacggtgcacttatcaccacctgataccatacatacttatttgtacagtaaatatgtcctccactaaagtgagacaagatgatggtagagatgacatctgttgtattcactgttatctcaccactacctggctcattgtagaaataccagagtgttattgttacaaatgtactgtaagtgcgtacatgtccaaaataacacattccaaggccaggtgtggtggctcatgcctgcaattcccagcactttggaaggncgaggagggtggatcacttgaggtcaggagttcgagaccagcctggcnaacatggagaaaccccatcnctactgaaactacaaaaattagctgggcatggtggagggtgcctgtaattccagcnactcaggacgctgaggcaggagaatngcttaaacccgggaggcagaggttgcagtgagccaagatcgcaccattgcactccagcctaggcgacaagagcaaaactccgtctcaaaacaaacaaaaacaaattaacacattccagatacaagcagcattacaaaaaatcagtgctatgtgggaaaccattagatgggaaggcaaataatatgaatagaaaagtggctttttttttttttctgtaaatcanggntccttgttttttaaagctaccttagaagctgaccagtattctgatgctcaataagttggtgaagaattcactatagttctgtcacagctaataaatctttttttttttttagatagagtcttgccctgtcgccaggnnggagcacagcggcgcaatctcagctcactgcaacctccgcaaagaaaaacaggaaatggtgcactctgctctgatacgtattaacagttgtcgttagcagagtcaccgtgtttcctggaaacaaattctttataggaaactttgttaagaccgtcaaccatctgaataatccttgcatccttaaaatattaacttttattctgcataaggtgaaggactagagacccaaatgaactgctatgttagtgtggaggggacattaggcaaaatgtctcttcccataactttttacataattacatcataattattaaagataatgaactaaacaatttggagtatatccaaggaggcgagaagcaggttaatttcaaaggatttgctactgtgagaaccttatttgcatccttatctaaacaatatgtatataaccatactatatctacctccctcacatttctggcatatggatcaactgtagcttctagaaaacagtaattacatcatcacttaaaagttaaaactttcccaaagactattctctgggcagcttagtgtgcaaacacatgtcactgagaagcaaatgaaggccaggtcccatcaggttagcagaaggcctacagtaagagtaaaagatggtacagcctgaggtagttctagaagcagatacagagtgaataaagaaaatgaaaatacttgccatctgggacagtgaaaaaagctggaactttcagggtataaaatagcaatcatttatgcaaatgtggccaaagtaaatgaaaggttgaaagctatgctgactcaactttatgacctagagaaagtcagttgagttgtgtaactaaatccctaaatctatgaattaaatctaacaagcccactatttccaaattgtgtcttggggcatcccagcaaaacccaggggtgccagggttttctatttgagggaaacacagtgaggctcaatgtgtgtttgacactgagtgaactaccagcttcagataatttgtaacccc

SEQ ID NO: 71590 - DNA, 392 bp, Homo sapiens
cgagctgcctccaggcctgttcccagacctcggtgcccgccagatgctctgcgaattccctccgcccgccccagccttcccgcaccctccgcgctccctgaacgtcccagggaagctctgttcgcttttgttttttttttttttccctttttcgcaaccccttcttggcttcctttatcccttgaattttgtatgtttcctgaaagacacgtgggaggccagtgtctcgtgtggaatctgccagtcagtgcagcgctttcccggagttgagtttactctgcagctcttttgaatgtttgagccctgtctgcctataggtctcgtcaagaccagcccatgtttcttaaaaactgcagtattatgaagagttcctgtgccttgccgcgttttca

SEQ ID NO: 71591 - DNA, 1080 bp, Homo sapiens
gttcaactactgctcccagctggaggacgagaatagctcagctgggctggatattcctgggccaccctgcaccaaggccagtccagagcctgctaagcccaagcccggggctgagccggagccggagcccagcacagcctgcccacagaagcagaggcaccggccggcgagcgtgaggcgagccatgggcacggtgatcattgcaggggtcgtgtgcggcgtcgtctgcatcatgatggtggtggccgctgcctatggctgcatctacgcctccctcatggccaagtaccaccgggagctcaaaaagcgccagcccctgatgggggaccccgagggcgagcacgaggaccagaagcagatctcttctgtggcctgagcgcccatccccacccggccaggtaggaagggcggggagagcacacggcattgctcagccacagctcccaccttgacccggcgctggccactgcctccccgagtccaccctcctccccgccctccagcagacaagccacaccgggttctctccctgcactttcgaggctccctgaaagccaccgtgctgggggctcctgctgatgctcctgtctgggccagtaaatctttggaacatgtgggggggatctccctaagctctggccacagcaaagcaaggaggtgtgtgcaagaggaggcttccggactgggcattcccctgtcgcccttcctgccctggggtggccatagctggtgactcttcctaccttgctggtcccacctcacctgcattgaggggacggggagggagggatctgagggatgaaggtagatttctgagactctctcctaagccagaaagacgttcttaacacccctgcagtgtgaaagctggtccagctctacaactgttggtaccaatgtgcaaacacaccagccctgccatctggacccagcactcagaaacaccatacacccctggccgacgccatcatgcccctggatctgctataggccacactgaccacatgctcctggattcgctaattcactcacacacccattgcatcaccagtgcggtcacatggattgaaagaattaata

SEQ ID NO: 71592 - DNA, 510 bp, Homo sapiens
cgcccagactggagtgcagtggtgtgatcgtggctcactgcaacccctgccttctgggttcaagtgattctcttgcctcatccacccgagtggctgggactaccagcatgcaccaccacgcccagctaatttttgtatttttagtagagatgaggtctcaccatgttggccagggctggtcttgaactcctggcctcaagtgatccgcccgctttggtgtcccaaagtgctgggattacaggtgtgaaccaccacgcccagcccctgctgagctatttgatagttttggtacaccaagagcaaaattctaccagaaatgtacctcttgctgacataattggagctgggtccaatccctaacaatcaactcgtttctcccattcaatcctcttctgttttttctttttttagagataagatcttgctctgttgcccagacttggagtggcacgatcacggctcactgcagccttgaactcctggactcaagcgaacctcccacctcagctt

SEQ ID NO: 71593 - DNA, 547 bp, Homo sapiens
attccatactaaacagatttataataagtaactaatatttattattaatatttgctatgtgcctggcattagattaaatattttaaatcccatatataacttaccacaataattttacaaagtaggtatattaatatatttacactttagatgaggttacagatttaggaagtgtaaattgaccaagtggatttaaagccagatctgcccaacagaagggcttgtttattcactatagcacatcactttgctttttatatcacttatttatcagtgaattcaaatcctaccaactccatgaaatctttcttccttccccacagtaatctttttctttataaacaattcagtgattttagtatattcacagagttatgcatgctttaccacattcgattttagagtattttcacagccccaaaaagaaaccccataccctttggccccaacttctccctcctctccccagccctaggcaaccagtaatccactttccgtctgtatgcatttgtctatcttgaacatttcatataaatggaatcatgca

SEQ ID NO: 71594 - DNA, 328 bp, Homo sapiens
gtatttcagaaaatataagcttttaaagtatttattttgaagacaaacattacaaataaaagagggttgtaatacctttatttgtatcacagatcttattgtacacattttgtactagagaaaaccctgaagcagttacttaaactttgttcaacatcagggaattcagattggagaaaaaccctgcaaatgtaataaatttgaaaaaaaagttttccaaaactacaacttagacaacaccagagggttcatactgagatatatttttgcagatgcagtatatatttaaaacatttaatccaaaataaaaatgtaaatatcagagaat

SEQ ID NO: 71595 - DNA, 838 bp, Homo sapiens
gaaattgagttcctaagctgtagagccttagaaccctggcatacatttctgtggagaaacagaaagcccagacatcccagtccacacacgtctttcttctgaccaacaccagccataggaagcaaggcccgggagagcactggggacagggcatgtccgcccggagcagggcaggagagcacaggcatgtgatgcagccctgggtctgtcgtcccgtttgcgccgggaatgaatcgggtttttctagcctctaagcacagaggtatttttgactcagcaccgtgaagagacgacaatagctcagcttctgccagctgcccgatttagacacgagaccttcactacatatttctgtctcttgccctactcagaagaaggacttaaaaatcccccaagacggaactgagttttcctctgttcatttttttaaattacactacttgaagaaccccaaacaaataaggctctgggcctccaagaccatgtaatccattgtgctcgtgtggaagagctgcccccagtagaggcaacaggaatggcctggtcactcagcaggtcccctgcccatcttcccaccaccccttgccccacccaccgggaaggaggagggagcacaggctgctttgagcagtcatcgtgcctctacctggagcctgtactcactgtcttgggggccggtatttcccaggagggctattgtgtgtttccttgtctgtttctctttctggaatgcgagctgtttcaaaatgaactgaagatcattcacctccacccctcagctctcagcatagaggtgtgcacagagtacatgctcagtaaatgtttaacagatataaaa

SEQ ID NO: 71596 - DNA, 163 bp, Homo sapiens
gcatctattcctagcaactggagtttttgagaaacaaggaggacactaatgtgactggaatgggttgaacaagggaaagacaagtactgagagctaatgggggatcagatgatacagtgtctggtaggtcacggtaagactcactaaagatttttatcctcat

SEQ ID NO: 71597 - DNA, 376 bp, Homo sapiens
tgttcttggattctttatttgtatcccaccaacttccaaaatgatgacttgcagcaggttacaacaaaagacacacaaacaatagaaatattcagacaagggtaaaaggtcaagagaccgggtatttgagctatccatttagcacattatttttccagctgggaaatctactgcaaaactgaactaagatcagaaaggtgcttcataaatatatagtttaattctagcaatatatttgaagtgcttagatagcaaacctctctgtatttcactataatggcccagcttaatttgtcatctttttttccctccttttaaagcattgctgagactttaagatactcattgtgaattaatttgggatttggcataataa

SEQ ID NO: 71598 - DNA, 818 bp, Homo sapiens
tgaatattcacaaagtgtgcaactattaccactatttaaatctaaaatacttcatcaccctcacgtcccattcccattagcacttactccctattcccctctccccccagtttctggcgtcctattttctgtctttatggatttgcctattcaggacattttgtataattggaatcatacaatatttggcttttgtgtctggtgtctttcacttagcataatgttttcaaggttcatccataatgtagcatgtatcagaagttcatttctttttatggctgaacaagattccattgtgtgattagattgcattttctttatccgtctgttgatggacgtttggggttgttccactttttggccattgtgaagaatgattctttgaacattgatgtaaaagatttcatgtggatatgtattttcatttctgttggctgtataccttgcagtagaattgctgggttgtacctttaactttctgagtaactgctcaaacacagtaaacacacagttttccagttttgcagcactattttatgttcttaccagcaacctgggaagaatttccactttctccacatcctcgccaacaattgtcattgtctatctttttcattatagtcaccatagtggggtgtaaagtgggtatctcattgtgggtattgatttggctttaccttgatgagtaatgggtattgaacatctttttcatgtgcttattagcccttaaataccttgcttggagaaatgtctattcaaataaatcttttgcccattttctaaaggagttaattgcctatttattgttgagttttaag

SEQ ID NO: 71599 - DNA, 548 bp, Homo sapiens
ccaaatgctgcttggaggcccgaggtactgtcctggccttcagggaacctgagctttgggtaggttatgctgaagagcctgtaggccatatgcacagttggcttatttagaaactgtagacatttgtctgtgtgaagattatctgctgtcaacactgcttttgaggccattatcacgttcagctagaagacttgcttctctccaagagtttgagcaggttgggcacagtgatttacacctgtaatcccagtgctttgggaggctgaggtaggaggatcacttgagaccaggagttcgagaccagcctgggcaacacggtgaaactcagctctacaaaaaataaaaaaaaatcagccaggcgtggtggtacatgcctgtagtcccagctgcaggggaggctgaggcaggaggattgcttgagccaaggctaccatgaggtagggtcacatcattgcattctagcctgggcaatagagtgacaccctgtgtcataaagaaaagagtctgggtgccaggaaagacctgtccattggtctagagtgattttg

SEQ ID NO: 71600 - DNA, 169 bp, Homo sapiens
aatcagacacacatcttctaacctgaagtgcttttaacagagcatggctgcatgttggaatcatccacaccattaagaggagaattctggaaaggcaatatgttacattttgcttaaagtctgtccaacaacttcagtctttcaaggaccaccgtcaaggtttttgcaa

SEQ ID NO: 71601 - DNA, 1252 bp, Homo sapiens
  misc_feature (1164)..(1164): n is a, c, g, or t
  misc_feature (1241)..(1241): n is a, c, g, or t
ggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcggacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattngcccgggggcattaagttgaggtgttccaatgggccggtattttcccacaacagcctgggcactccaaccgttaccntttatggagta

SEQ ID NO: 71602 - DNA, 257 bp, Homo sapiens
  misc_feature (217)..(217): n is a, c, g, or t
ctcgacgaacgaacgactgagaatgcccagtggtgcagctcttctctcctgtgaactaacagccagattgtttgtaatttcccgtgctatttaaaacagggttctcatgtatcagccatcttctgtaagggtgcccagtgtgacttcggttgatcctgctgctattccgccttcattaaaaaacaaaagaaacaaaaacactccacatacctggcanatctgatgacatgcttgatattggcggtcgacgcggccgc

SEQ ID NO: 71603 - DNA, 1392 bp, Homo sapiens
  misc_feature (1392)..(1392): n is a, c, g, or t
agaactctttgcagtcaaacctacccaacccatccaggagctgctacacattgaggaaggggcagaatgaatgctgggaagcaactacaaagaacactgcacaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttagttcaaagcagtattcagcgatttcaagagaagttttttatttttgctttgacacctcaacaagttagagagatatgcatatccagggattttttgccaggtggtaggagagattatacagtccaagttcagttgagactttgcctggcagagacaagttgccctcaagaagataactatccaaatagtctatgtataaaagtaaatgggaagctatttcctttgcctggctatgcaccaccgcctaaaaatgggattgaacagaagcgccctggacgccccttgaatattacatctttagttaggttatcttcagctgtgccaaaccaaatttccatttcttgggcatcagaaattgggaagaattactctatgtctgtatatcttgtacggcagcttacatcagccatgttattacagagattaaaaatgaaaggtattagaaaccctgatcattccagagcactaattaaagaaaaacttactgcagatcctgatagtgaaattgctacaactagccttcgggtatccttgatgtgccctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggtaagtatatcccttttaacagctgatatggactaatacaacagctgttggcaatgcctttgttcactacaacttactgaactaaattctaaataaattctactctagcatn

SEQ ID NO: 71604 - DNA, 790 bp, Homo sapiens
tcttttttgtgttctgttaaatggagctaaataacgcctatattacaggatcattttcaggttttaatgagatgaaagaaagcctcggtgtcaggcatgtggtaatttcccaataaaaattgattcctttcccttttcaccctctccagggcaaaatataggtgggtaggatggcattctacctgaattttagcgtggattctctgtaagttatctggcagaaggcattactgacctgcattaaaaatcaggtttgggtatttaacaatagttgctttttcagagaggttttgaaccataaaaggagataacaggagagttctcctggctgtctacgaacacattctttcaaacttgggtttgctagtgtcatctttttggcctcttggtccacttggttttctaatggctttactgagttataatttacatagcataaaatgtacccatcttaagtatataatggcacaattcagtgattttagtaaatacatagagctgtgcaatcatcaccatgattcagtagtagaatattttcaacacccaaaaaactttcttcatgttcttttgtagtttattcctatttacaccccaaatctaggcaatcgtttttttgtgtctataatgcctgtttagacattttatataaaatgtcttgttttgcaacattgtttatttttataattttaagaattaaaccttttcagctgccttctttgctgttaaaatacttacatttccaaatataatttacacatatattaaaggcatatatttacttctacccatt

SEQ ID NO: 71605 - DNA, 476 bp, Homo sapiens
tactactactaaattcgcggccgcgtcgatatagtatttctttctaataaagttttatgttgctgctctaaatacagatgcaatatttattgactctgtaatcagatagaaaaaacttaacttggtttgtgtggtatgacttataaagaaatgatgtatatttgttattttgttaccctttagattgtcagagactcccccaatttaatcaacaaagttttataaagtaaatgaaaatattaatagaaattagtttatttacttggttcttataactgatatctctgtgcttttataattgtgatttgtttttttgttttttttcaagatgataaacttcaaagtgtattttttaaaatgcaagttgcctgtatgaaataaattaaaaatttatatgtaatttcagtgtaaaacaccaaaaccgaacattaaaactgttcacagaaaatagaaaaaaagtcgacgcggccgcgaat

SEQ ID NO: 71606 - DNA, 4048 bp, Homo sapiens
agcggggcggaggcggagctcccgcgccgttcacgtgacgggcccggctgtagcggcggcggccgcggcgtcttaagcggcgcccagtgcaggatggtgctggaggcggcggcggccgtggtggcggcagcgtcgttggcggcagcgggagtgggtgcggcggcagcggcggcggcgcccgcgggtggtataaaatggcggatttcgaagagttgaggaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttagttcaaagcagtattcagcgatttcaagagaagttttttatttttgctttgacacctcaacaagttagagagatatgcatatccagggattttttgccaggtggtaggagagattatacagtccaagttcagttgagactttgcctggcagagacaagttgccctcaagaagataactatccaaatagtctatgtataaaagtaaatgggaagctatttcctttgcctggctatgcaccaccgcctaaaaatgggattgaacagaagcgccctggacgccccttgaatattacatctttagttaggttatcttcagctgtgccaaaccaaatttccatttcttgggcatcagaaattgggaagaattactctatgtctgtatatcttgtacggcagcttacatcagccatgttattacagagattaaaaatgaaaggtattagaaaccctgatcattccagagcactaattaaagaaaaacttactgcagatcctgatagtgaaattgctacaactagccttcgggtatccttgatgtgccctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggctttttatggaaattctcaatgactgttctgatgtagatgagatcaaattccaagaagatggttcttggtgtccaatgagaccgaagaaagaagctatgaaagtatccagccaaccgtgtacaaaaatagaaagttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaaggggttctcatgtatcagccatcttctgtaagggtgcccagtgtgacttcggttgatcctgctgctattccgccttcattaacagactactcagtaccattccaccatacgccaatatcaagcatgtcatcagatttgccaggtttggattttctttcccttattccagttgatccccagcagtactgtcctcctatgtttttggatagtctcacctcacccttaacagcaagcagtacgtctgtcaccaccaccagctcccatgaaagcagtactcatgttagttcatccagcagcaggagtgagacaggggtcataaccagcagtggaagtaacattcctgacatcatctcattggactaaaggaggactcacttgattctgggaatcattcatcagaactgctttttcttggatctctagtctgtggaaacgttcttttttttttttttttaataatttggtatttattgaaagtcagatggattcttttgctttctgaggggtgaacacagaagactgcaacaagaaccaaatgacatgcaaggatttttcttaattatgctgtactctcagcatcagatacattcaaccataactgtatcttcctgagagatggatttcactttcatacgttaatggatggagtctacaaatcagtgaaaaaagtttttgttaaaataaagagcaataaaattatgtaaatattcaagtaaccttttttctaattaaaaaaaaaattgtaatcactgattctagaatgacagcaacttctgtttaaccttacgtgaaggaaaaaaaatatatggaaagaacttaatgtttgctgaatgagtcctttccatggagatttgctctgtttcattgaagtaatgaagtttcagtacgtggccaaagcttggattccacttttcgtcctgcatttccacttttcttcgtgattgcatcaaagaaaaatggcattcgtgttacttggtttttttcctgcttatcatttacactttgacgttgtttgctaatgagtgctgtgtgaagttctgggatttggctactcttcattggtgattatgtttaaaagcactatgcagattctgccctgacataaagtgtgttattatgtttttagtaattgtacatttttcattctagagttttctataaatttgaggcttgccttctcaaaaaagaaactatgcagccattgaatgaaatgtctttggggtacggtgtgactggaatgtttgttagaaatttgttcacactatcaaatattgatatcttggagccagcagaagagcagattttgggaggtggtaataacaaaatttaatttcttcccaacaacttaattttctcatttattttacagaatagtagtgaaatatttgatgaaactttgtattttggtagcactacatagaaaatgtgttttagatttatgatgatcatatttctcaccaatgtaatttcagtctcagcagtgattttcaaacttagggaaagggacagcattagatttttttttttttcatttttttaaaatgatatcttacctgaaactacaaacgacaaaagagaattagaaatgtttgaattaaagtgaagaagggttgggggagatgggcctgaacccacttcctgtctcaatccatgctaccccaaacactccagggaacctctgaggttttattgggtgcactttgaaaatttctcttctatagtgtgtttgtttgattttaaatcacagagaaaactgggttttactcttagagaaacattttcatccagttttttagtttgcttcatttgacttcctaaatcatttttgagttcacaaggatttggtacttttctgtttagctttctctctctaagctttatctaccttaaaaacaaagtcctttttttaatggccagtccaaccaattgatttctcaaactgaagtgcccaggtgtggactcatcaatttccgttagaatagggacatcctacttaagagttggtgcagctccaaggagctgacttgtccttgcttggggttttttttttttttcacccttctcaagtttccatggcctttgtgtgttctttttatgttgatttaaattcatatggttttccacaaatcccttctttggctacattgtctccttattcaatggattatccctttgtgggggctgcttattttaaagatgttgggggggaaacaaacccaaatctacgagcagtagttgcacatagttgccagttttaccttcttagtcattagatttccaaaccatgttgcagttttttggtccagatatagtatttctttctaataaagttttatgttgctgctcta

SEQ ID NO: 71607 - DNA, 1896 bp, Homo sapiens
agcggggcggaggcggagctcccgcgccgttcacgtgacgggcccggctgtagcggcggcggccgcggcgtcttaagcggcgcccagtgcaggatggtgctggaggcggcggcggccgtggtggcggcagcgtcgttggcggcagcgggagtgggtgcggcggcagcggcggcggcgcccgcgggtggtataaaatggcggatttcgaagagttgaggaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttagttcaaagcagtattcagcgatttcaagagaagttttttatttttgctttgacacctcaacaagttagagagatatgcatatccagggattttttgccaggtggtaggagagattatacagtccaagttcagttgagactttgcctggcagagacaagttgccctcaagaagataactatccaaatagtctatgtataaaagtaaatgggaagctatttcctttgcctggctatgcaccaccgcctaaaaatgggattgaacagaagcgccctggacgccccttgaatattacatctttagttaggttatcttcagctgtgccaaaccaaatttccatttcttgggcatcagaaattgggaagaattactctatgtctgtatatcttgtacggcagcttacatcagccatgttattacagagattaaaaatgaaaggtattagaaaccctgatcattccagagcactaattaaagaaaaacttactgcagatcctgatagtgaaattgctacaactagccttcgggtatccttgatgtgccctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggctttttatggaaattctcaatgactgttctgatgtagatgagatcaaattccaagaagatggttcttggtgtccaatgagaccgaagaaagaagctatgaaagtatccagccaaccgtgtacaaaaatagaaagttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaaggggttctcatgtatcagccatcttctgtaagggtgcccagtgtgacttcggttgatcctgctgctattccgccttcattaacagactactcagtaccattccaccatacgccaatatcaagcatgtcatcagatttgccagagaacaaagtataaatgattttattgacttgagctttgtacttttctgtctggg

SEQ ID NO: 71608 - DNA, 2080 bp, Homo sapiens
agcggggcggaggcggagctcccgcgccgttcacgtgacgggcccggctgtagcggcggcggccgcggcgtcttaagcggcgcccagtgcaggatggtgctggaggcggcggcggccgtggtggcggcagcgtcgttggcggcagcgggagtgggtgcggcggcagcggcggcggcgcccgcgggtggtataaaatggcggatttcgaagagttgaggaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttagttcaaagcagtattcagcgatttcaagagaagttttttatttttgctttgacacctcaacaagttagagagatatgcatatccagggattttttgccaggtggtaggagagattatacagtccaagttcagttgagactttgcctggcagagacaagttgccctcaagaagataactatccaaatagtctatgtataaaagtaaatgggaagctatttcctttgcctggctatgcaccaccgcctaaaaatgggattgaacagaagcgccctggacgccccttgaatattacatctttagttaggttatcttcagctgtgccaaaccaaatttccatttcttgggcatcagaaattgggaagaattactctatgtctgtatatcttgtacggcagcttacatcagccatgttattacagagattaaaaatgaaaggtattagaaaccctgatcattccagagcactaattaaagaaaaacttactgcagatcctgatagtgaaattgctacaactagccttcgggtatccttgatgtgccctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggctttttatggaaattctcaatgactgttctgatgtagatgagatcaaattccaagaagatggttcttggtgtccaatgagaccgaagaaagaagctatgaaagtatccagccaaccgtgtacaaaaatagaaagttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaaggggttctcatgtatcagccatcttctgtaagggtgcccagtgtgacttcggttgatcctgctgctattccgccttcattaacagactactcagtaccattccaccatacgccaatatcaagcatgtcatcagatttgccaggagaacaaagaagaaatgatattaataatgaactgaagcttggaacatcttctgatactgtgcaacagtgaatacaaaataaaacaaataatttgtatttatggagtggaaaacagcttatttcaaggaaaaatatgactgccttattattgctagtgccatattgtcaggtgcgaatggtgctcaaaagttgtatcattaaaatttgaaagtgctaaacatttacatatttaatcat

SEQ ID NO: 71609 - DNA, 3424 bp, Homo sapiens
ctctgagagctccaggaatttggcacgagcagacattgggaagaattactctatgtctgtatatcttgtacggcagcttacatcagccatgttattacagagattaaaaatgaaaggtattagaaaccctgatcattccagagcactaattaaagaaaaacttactgcagatcctgatagtgaaattgctacaactagccttcgggtatccttgatgtgccctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggctttttatggaaattctcaatgactgttctgatgtagatgagatcaaattccaagaagatggttcttggtgtccaatgagaccgaagaaagaagctatgaaagtatccagccaaccgtgtacaaaaatagaaagttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaaggggttctcatgtatcagccatcttctgtaagggtgcccagtgtgacttcggttgatcctgctgctattccgccttcattaacagactactcagtaccattccaccatacgccaatatcaagcatgtcatcagatttgccaggtttggattttctttcccttattccagttgatccccagcagtactgtcctcctatgtttttggatagtctcacctcacccttaacagcaagcagtacgtctgtcaccaccaccagctcccatgaaagcagtactcatgttagttcatccagcagcaggagtgagacaggggtcataaccagcagtggaagtaacattcctgacatcatctcattggactaaaggaggactcacttgattctgggaatcattcatcagaactgctttttcttggatctctagtctgtggaaacgttcttttttttttttttttaataatttggtatttattgaaagtcagatggattcttttgctttctgaggggtgaacacagaagactgcaacaagaaccaaatgacatgcaaggatttttcttaattatgctgtactctcagcatcagatacattcaaccataactgtatcttcctgagagatggatttcactttcatacgttaatggatggagtctacaaatcagtgaaaaaagtttttgttaaaataaagagcaataaaattatgtaaatattcaagtaaccttttttctaattaaaaaaaaaattgtaatcactgattctagaatgacagcaacttctgtttaaccttacgtgaaggaaaaaaaatatatggaaagaacttaatgtttgctgaatgagtcctttccatggagatttgctctgtttcattgaagtaatgaagtttcagtacgtggccaaagcttggattccacttttcgtcctgcatttccacttttcttcgtgattgcatcaaagaaaaatggcattcgtgttacttggtttttttcctgcttatcatttacactttgacgttgtttgctaatgagtgctgtgtgaagttctgggatttggctactcttcattggtgattatgtttaaaagcactatgcagattctgccctgacataaagtgtgttattatgtttttagtaattgtacatttttcattctagagttttctataaatttgaggcttgccttctcaaaaaagaaactatgcagccattgaatgaaatgtctttggggtacggtgtgactggaatgtttgttagaaatttgttcacactatcaaatattgatatcttggagccagcagaagagcagattttgggaggtggtaataacaaaatttaatttcttcccaacaacttaattttctcatttattttacagaatagtagtgaaatatttgatgaaactttgtattttggtagcactacatagaaaatgtgttttagatttatgatgatcatatttctcaccaatgtaatttcagtctcagcagtgattttcaaacttagggaaagggacagcattagatttttttttttttcatttttttaaaatgatatcttacctgaaactacaaacgacaaaagagaattagaaatgtttgaattaaagtgaagaagggttgggggagatgggcctgaacccacttcctgtctcaatccatgctaccccaaacactccagggaacctctgaggttttattgggtgcactttgaaaatttctcttctatagtgtgtttgtttgattttaaatcacagagaaaactgggttttactcttagagaaacattttcatccagttttttagtttgcttcatttgacttcctaaatcatttttgagttcacaaggatttggtacttttctgtttagctttctctctctaagctttatctaccttaaaaacaaagtcctttttttaatggccagtccaaccaattgatttctcaaactgaagtgcccaggtgtggactcatcaatttccgttagaatagggacatcctacttaagagttggtgcagctccaaggagctgacttgtccttgcttggggttttttttttttttcacccttctcaagtttccatggcctttgtgtgttctttttatgttgatttaaattcatatggttttccacaaatcccttctttggctacattgtctccttattcaatggattatccctttgtgggggctgcttattttaaagatgttgggggggaaacaaacccaaatctacgagcagtagttgcacatagttgccagttttaccttcttagtcattagatttccaaaccatgttgcagttttttggtccagatatagtatttctttctaataaagttttatgttgctgctctaaatacagatgcaatatttattgactctgtaatcagatagaaaaaacttaacttggtttgtgtggtatgacttataaagaaatgatgtatatttgttattttgttaccctttagattgtcagagactcccccaatttaatcaacaaagttttataaagtaaatgaaaatattaatagaaattagtttatttacttggttcttataactgatatctctgtgcttttataattgtgatttgtttttttgtttttttttctattttctgtgaacagttttaatgttcggttttggtgttttacactgaaattacatataaatttttaatttatttcatacaggcaacttgcattttaaaaaatacactttgaagtttatcatcttgaaattg

SEQ ID NO: 71610 - DNA, 3561 bp, Homo sapiens
aaattcatactggttagtagatattttaaatgtacccactgatattctctattttgcataaaagcataatgtcagactttctctgtgtggtggttatattcggggtgtctctgaatgccagcataaaaattcacggaattgaatagaaattggcctgtcttaatgacctatggtttcttttttaatgttttgaaataattaaagagagtttagtcacacagggaggtctaggtgaactgatgttgaagtttattactagacttttcagacctaaaaattttatttattgttattacttgaatatgtcaaaagtatattactggacaaccttttacacattcctctttctaaaatcgaattggacaattacagttctctggttcagaaaattacattagctcagaacccagtaacccttgataaccctgttagcgcagcaattcccgagtgtgtgctttgtgcagagcgttggactatgtactgctcttgatgtggggacagcggggacagagagctgtcattgaaatagacatctgtttaagaagcgatacttagatgaacctctgtatttctgaaaaataaatgtgaaatatcttaagagcttaagtatgtttttttttttagatggttcaaatccagatcattagctcatcatttttattgcttctcattctgttaagcggcaaagggggaaatatttgttttgactagtccttcactggaaagttttggacttctgcatttgagtctctgggagctagtttttccagttgttttatcagagaatatattcatctttgggttttaaacacttcaaatatcactgatcatggtatagaacttctctgtgacagagtggtaagcacttaccacaaatgttttgtgatttgtgataaagatgatttagggaaataattctggtctcccaaaatatgagacaactattaacaaagcatttttgttttaggtttggattttctttcccttattccagttgatccccagcagtactgtcctcctatgtttttggatagtctcacctcacccttaacagcaagcagtacgtctgtcaccaccaccagctcccatgaaagcagtactcatgttagttcatccagcagcaggagtgagacaggggtcataaccagcagtggaagtaacattcctgacatcatctcattggactaaaggaggactcacttgattctgggaatcattcatcagaactgctttttcttggatctctagtctgtggaaacgttcttttttttttttttttaataatttggtatttattgaaagtcagatggattcttttgctttctgaggggtgaacacagaagactgcaacaagaaccaaatgacatgcaaggatttttcttaattatgctgtactctcagcatcagatacattcaaccataactgtatcttcctgagagatggatttcactttcatacgttaatggatggagtctacaaatcagtgaaaaaagtttttgttaaaataaagagcaataaaattatgtaaatattcaagtaaccttttttctaattaaaaaaaaaattgtaatcactgattctagaatgacagcaacttctgtttaaccttacgtgaaggaaaaaaaatatatggaaagaacttaatgtttgctgaatgagtcctttccatggagatttgctctgtttcattgaagtaatgaagtttcagtacgtggccaaagcttggattccacttttcgtcctgcatttccacttttcttcgtgattgcatcaaagaaaaatggcattcgtgttacttggtttttttcctgcttatcatttacactttgacgttgtttgctaatgagtgctgtgtgaagttctgggatttggctactcttcattggtgattatgtttaaaagcactatgcagattctgccctgacataaagtgtgttattatgtttttagtaattgtacatttttcattctagagttttctataaatttgaggcttgccttctcaaaaaagaaactatgcagccattgaatgaaatgtctttggggtacggtgtgactggaatgtttgttagaaatttgttcacactatcaaatattgatatcttggagccagcagaagagcagattttgggaggtggtaataacaaaatttaatttcttcccaacaacttaattttctcatttattttacagaatagtagtgaaatatttgatgaaactttgtattttggtagcactacatagaaaatgtgttttagatttatgatgatcatatttctcaccaatgtaatttcagtctcagcagtgattttcaaacttagggaaagggacagcattagatttttttttttttcatttttttaaaatgatatcttacctgaaactacaaacgacaaaagagaattagaaatgtttgaattaaagtgaagaagggttgggggagatgggcctgaacccacttcctgtctcaatccatgctaccccaaacactccagggaacctctgaggttttattgggtgcactttgaaaatttctcttctatagtgtgtttgtttgattttaaatcacagagaaaactgggttttactcttagagaaacattttcatccagttttttagtttgcttcatttgacttcctaaatcatttttgagttcacaaggatttggtacttttctgtttagctttctctctctaagctttatctaccttaaaaacaaagtcctttttttaatggccagtccaaccaattgatttctcaaactgaagtgcccaggtgtggactcatcaatttccgttagaatagggacatcctacttaagagttggtgcagctccaaggagctgacttgtccttgcttggggttttttttttttttcacccttctcaagtttccatggcctttgtgtgttctttttatgttgatttaaattcatatggttttccacaaatcccttctttggctacattgtctccttattcaatggattatccctttgtgggggctgcttattttaaagatgttgggggggaaacaaacccaaatctacgagcagtagttgcacatagttgccagttttaccttcttagtcattagatttccaaaccatgttgcagttttttggtccagatatagtatttctttctaataaagttttatgttgctgctctaaatacagatgcaatatttattgactctgtaatcagatagaaaaaacttaacttggtttgtgtggtatgacttataaagaaatgatgtatatttgttattttgttaccctttagattgtcagagactcccccaatttaatcaacaaagttttataaagtaaatgaaaatattaatagaaattagtttatttacttggttcttataactgatatctctgtgcttttataattgtgatttgtttttttgtttttttttctattttctgtgaacagttttaatgttcggttttggtgttttacactgaaattacatataaatttttaatttatttcatacaggcaacttgcattttaaaaaatacactttgaagtttatcatcttgaaattg

SEQ ID NO: 71611 - DNA, 2913 bp, Homo sapiens
  misc_feature (197)..(197): n is a, c, g, or t
ttgattttgactggtttttcctctgagtgacaaaagagaaagccttggttcaagtagtctggcactggaaattttgggactgctgcttttgagttgttgtgttgggaagcacttttttctagttgttttggtcaaaaaaaatgtatttgggttttagatgcattcaatataaccagctatgatcatagaacttcacntgtggcagtgaaatgaacattaccacagatgtctcttggcttataaatacagaatgatttagggaaataattctggtctcccaaaatatgagacaactattaacaaagcatttttgttttaggtttggattttctttcccttattccagttgatccccagcagtactgtcctcctatgtttttggatagtctcacctcacccttaacagcaagcagtacgtctgtcaccaccaccagctcccatgaaagcagtactcatgttagttcatccagcagcaggagtgagacaggggtcataaccagcagtggaagtaacattcctgacatcatctcattggactaaaggaggactcacttgattctgggaatcattcatcagaactgctttttcttggatctctagtctgtggaaacgttcttttttttttttttttaataatttggtatttattgaaagtcagatggattcttttgctttctgaggggtgaacacagaagactgcaacaagaaccaaatgacatgcaaggatttttcttaattatgctgtactctcagcatcagatacattcaaccataactgtatcttcctgagagatggatttcactttcatacgttaatggatggagtctacaaatcagtgaaaaaagtttttgttaaaataaagagcaataaaattatgtaaatattcaagtaaccttttttctaattaaaaaaaaaattgtaatcactgattctagaatgacagcaacttctgtttaaccttacgtgaaggaaaaaaaatatatggaaagaacttaatgtttgctgaatgagtcctttccatggagatttgctctgtttcattgaagtaatgaagtttcagtacgtggccaaagcttggattccacttttcgtcctgcatttccacttttcttcgtgattgcatcaaagaaaaatggcattcgtgttacttggtttttttcctgcttatcatttacactttgacgttgtttgctaatgagtgctgtgtgaagttctgggatttggctactcttcattggtgattatgtttaaaagcactatgcagattctgccctgacataaagtgtgttattatgtttttagtaattgtacatttttcattctagagttttctataaatttgaggcttgccttctcaaaaaagaaactatgcagccattgaatgaaatgtctttggggtacggtgtgactggaatgtttgttagaaatttgttcacactatcaaatattgatatcttggagccagcagaagagcagattttgggaggtggtaataacaaaatttaatttcttcccaacaacttaattttctcatttattttacagaatagtagtgaaatatttgatgaaactttgtattttggtagcactacatagaaaatgtgttttagatttatgatgatcatatttctcaccaatgtaatttcagtctcagcagtgattttcaaacttagggaaagggacagcattagatttttttttttttcatttttttaaaatgatatcttacctgaaactacaaacgacaaaagagaattagaaatgtttgaattaaagtgaagaagggttgggggagatgggcctgaacccacttcctgtctcaatccatgctaccccaaacactccagggaacctctgaggttttattgggtgcactttgaaaatttctcttctatagtgtgtttgtttgattttaaatcacagagaaaactgggttttactcttagagaaacattttcatccagttttttagtttgcttcatttgacttcctaaatcatttttgagttcacaaggatttggtacttttctgtttagctttctctctctaagctttatctaccttaaaaacaaagtcctttttttaatggccagtccaaccaattgatttctcaaactgaagtgcccaggtgtggactcatcaatttccgttagaatagggacatcctacttaagagttggtgcagctccaaggagctgacttgtccttgcttggggttttttttttttttcacccttctcaagtttccatggcctttgtgtgttctttttatgttgatttaaattcatatggttttccacaaatcccttctttggctacattgtctccttattcaatggattatccctttgtgggggctgcttattttaaagatgttgggggggaaacaaacccaaatctacgagcagtagttgcacatagttgccagttttaccttcttagtcattagatttccaaaccatgttgcagttttttggtccagatatagtatttctttctaataaagttttatgttgctgctctaaatacagatgcaatatttattgactctgtaatcagatagaaaaaacttaacttggtttgtgtggtatgacttataaagaaatgatgtatatttgttattttgttaccctttagattgtcagagactcccccaatttaatcaacaaagttttataaagtaaatgaaaatattaatagaaattagtttatttacttggttcttataactgatatctctgtgcttttataattgtgatttgtttttttgtttttttttctattttctgtgaacagttttaatgttcggttttggtgttttacactgaaattacatataaatttttaatttatttcatacaggcaacttgcattttaaaaaatacactttgaagtttatcatcttgaaattg

SEQ ID NO: 71612 - DNA, 3114 bp, Homo sapiens
ctcaacagggatgactcagtacggggcgccgtactgctcttgatgtggggacagcggggacagagagctgtcattgaaatagacatctgtttaagaagcgatacttagatgaacctctgtatttctgaaaaataaatgtgaaatatcttaagagcttaagtatgtttttttttttagatggttcaaatccagatcattagctcatcatttttattgcttctcattctgttaagcggcaaagggggaaatatttgttttgactagtccttcactggaaagttttggacttctgcatttgagtctctgggagctagtttttccagttgttttatcagagaatatattcatctttgggttttaaacacttcaaatatcactgatcatggtatagaacttctctgtgacagagtggtaagcacttaccacaaatgttttgtgatttgtgataaagatgatttagggaaataattctggtctcccaaaatatgagacaactattaacaaagcatttttgttttaggtttggattttctttcccttattccagttgatccccagcagtactgtcctcctatgtttttggatagtctcacctcacccttaacagcaagcagtacgtctgtcaccaccaccagctcccatgaaagcagtactcatgttagttcatccagcagcaggagtgagacaggggtcataaccagcagtggaagtaacattcctgacatcatctcattggactaaaggaggactcacttgattctgggaatcattcatcagaactgctttttcttggatctctagtctgtggaaacgttcttttttttttttttttaataatttggtatttattgaaagtcagatggattcttttgctttctgaggggtgaacacagaagactgcaacaagaaccaaatgacatgcaaggatttttcttaattatgctgtactctcagcatcagatacattcaaccataactgtatcttcctgagagatggatttcactttcatacgttaatggatggagtctacaaatcagtgaaaaaagtttttgttaaaataaagagcaataaaattatgtaaatattcaagtaaccttttttctaattaaaaaaaaaattgtaatcactgattctagaatgacagcaacttctgtttaaccttacgtgaaggaaaaaaaatatatggaaagaacttaatgtttgctgaatgagtcctttccatggagatttgctctgtttcattgaagtaatgaagtttcagtacgtggccaaagcttggattccacttttcgtcctgcatttccacttttcttcgtgattgcatcaaagaaaaatggcattcgtgttacttggtttttttcctgcttatcatttacactttgacgttgtttgctaatgagtgctgtgtgaagttctgggatttggctactcttcattggtgattatgtttaaaagcactatgcagattctgccctgacataaagtgtgttattatgtttttagtaattgtacatttttcattctagagttttctataaatttgaggcttgccttctcaaaaaagaaactatgcagccattgaatgaaatgtctttggggtacggtgtgactggaatgtttgttagaaatttgttcacactatcaaatattgatatcttggagccagcagaagagcagattttgggaggtggtaataacaaaatttaatttcttcccaacaacttaattttctcatttattttacagaatagtagtgaaatatttgatgaaactttgtattttggtagcactacatagaaaatgtgttttagatttatgatgatcatatttctcaccaatgtaatttcagtctcagcagtgattttcaaacttagggaaagggacagcattagatttttttttttttcatttttttaaaatgatatcttacctgaaactacaaacgacaaaagagaattagaaatgtttgaattaaagtgaagaagggttgggggagatgggcctgaacccacttcctgtctcaatccatgctaccccaaacactccagggaacctctgaggttttattgggtgcactttgaaaatttctcttctatagtgtgtttgtttgattttaaatcacagagaaaactgggttttactcttagagaaacattttcatccagttttttagtttgcttcatttgacttcctaaatcatttttgagttcacaaggatttggtacttttctgtttagctttctctctctaagctttatctaccttaaaaacaaagtcctttttttaatggccagtccaaccaattgatttctcaaactgaagtgcccaggtgtggactcatcaatttccgttagaatagggacatcctacttaagagttggtgcagctccaaggagctgacttgtccttgcttggggttttttttttttttcacccttctcaagtttccatggcctttgtgtgttctttttatgttgatttaaattcatatggttttccacaaatcccttctttggctacattgtctccttattcaatggattatccctttgtgggggctgcttattttaaagatgttgggggggaaacaaacccaaatctacgagcagtagttgcacatagttgccagttttaccttcttagtcattagatttccaaaccatgttgcagttttttggtccagatatagtatttctttctaataaagttttatgttgctgctctaaatacagatgcaatatttattgactctgtaatcagatagaaaaaacttaacttggtttgtgtggtatgacttataaagaaatgatgtatatttgttattttgttaccctttagattgtcagagactcccccaatttaatcaacaaagttttataaagtaaatgaaaatattaatagaaattagtttatttacttggttcttataactgatatctctgtgcttttataattgtgatttgtttttttgtttttttttctattttctgtgaacagttttaatgttcggttttggtgttttacactgaaattacatataaatttttaatttatttcatacaggcaacttgcattttaaaaaatacactttgaagtttatcatcttgaaattg

SEQ ID NO: 71613 - DNA, 2799 bp, Homo sapiens
tgtggtcagcaaacaagttccacaagtttagagagaatcaagaatatatgctgcattctctaaataatgtaaaatagctaaattcatgctatcttccacccaaagatgtgaagttttgagcaatttttaaatcccactgggatttaaatatgtgactattgcttgtgcatatctaataatttctagtctctttatttaaaatcaagtagcctcttcctcattggcatcattgtttgtttcaagcagtactgtcctcctatgtttttggatagtctcacctcacccttaacagcaagcagtacgtctgtcaccaccaccagctcccatgaaagcagtactcatgttagttcatccagcagcaggagtgagacaggggtcataaccagcagtggaagtaacattcctgacatcatctcattggactaaaggaggactcacttgattctgggaatcattcatcagaactgctttttcttggatctctagtctgtggaaacgttcttttttttttttttttaataatttggtatttattgaaagtcagatggattcttttgctttctgaggggtgaacacagaagactgcaacaagaaccaaatgacatgcaaggatttttcttaattatgctgtactctcagcatcagatacattcaaccataactgtatcttcctgagagatggatttcactttcatacgttaatggatggagtctacaaatcagtgaaaaaagtttttgttaaaataaagagcaataaaattatgtaaatattcaagtaaccttttttctaattaaaaaaaaaattgtaatcactgattctagaatgacagcaacttctgtttaaccttacgtgaaggaaaaaaaatatatggaaagaacttaatgtttgctgaatgagtcctttccatggagatttgctctgtttcattgaagtaatgaagtttcagtacgtggccaaagcttggattccacttttcgtcctgcatttccacttttcttcgtgattgcatcaaagaaaaatggcattcgtgttacttggtttttttcctgcttatcatttacactttgacgttgtttgctaatgagtgctgtgtgaagttctgggatttggctactcttcattggtgattatgtttaaaagcactatgcagattctgccctgacataaagtgtgttattatgtttttagtaattgtacatttttcattctagagttttctataaatttgaggcttgccttctcaaaaaagaaactatgcagccattgaatgaaatgtctttggggtacggtgtgactggaatgtttgttagaaatttgttcacactatcaaatattgatatcttggagccagcagaagagcagattttgggaggtggtaataacaaaatttaatttcttcccaacaacttaattttctcatttattttacagaatagtagtgaaatatttgatgaaactttgtattttggtagcactacatagaaaatgtgttttagatttatgatgatcatatttctcaccaatgtaatttcagtctcagcagtgattttcaaacttagggaaagggacagcattagatttttttttttttcatttttttaaaatgatatcttacctgaaactacaaacgacaaaagagaattagaaatgtttgaattaaagtgaagaagggttgggggagatgggcctgaacccacttcctgtctcaatccatgctaccccaaacactccagggaacctctgaggttttattgggtgcactttgaaaatttctcttctatagtgtgtttgtttgattttaaatcacagagaaaactgggttttactcttagagaaacattttcatccagttttttagtttgcttcatttgacttcctaaatcatttttgagttcacaaggatttggtacttttctgtttagctttctctctctaagctttatctaccttaaaaacaaagtcctttttttaatggccagtccaaccaattgatttctcaaactgaagtgcccaggtgtggactcatcaatttccgttagaatagggacatcctacttaagagttggtgcagctccaaggagctgacttgtccttgcttggggttttttttttttttcacccttctcaagtttccatggcctttgtgtgttctttttatgttgatttaaattcatatggttttccacaaatcccttctttggctacattgtctccttattcaatggattatccctttgtgggggctgcttattttaaagatgttgggggggaaacaaacccaaatctacgagcagtagttgcacatagttgccagttttaccttcttagtcattagatttccaaaccatgttgcagttttttggtccagatatagtatttctttctaataaagttttatgttgctgctctaaatacagatgcaatatttattgactctgtaatcagatagaaaaaacttaacttggtttgtgtggtatgacttataaagaaatgatgtatatttgttattttgttaccctttagattgtcagagactcccccaatttaatcaacaaagttttataaagtaaatgaaaatattaatagaaattagtttatttacttggttcttataactgatatctctgtgcttttataattgtgatttgtttttttgtttttttttctattttctgtgaacagttttaatgttcggttttggtgttttacactgaaattacatataaatttttaatttatttcatacaggcaacttgcattttaaaaaatacactttgaagtttatcatcttgaaattg

SEQ ID NO: 71614 - DNA, 1069 bp, Homo sapiens
agcggggcggaggcggagctcccgcgccgttcacgtgacgggcccggctgtagcggcggcggccgcggcgtcttaagcggcgcccagtgcaggatggtgctggaggcggcggcggccgtggtggcggcagcgtcgttggcggcagcgggagtgggtgcggcggcagcggcggcggcgcccgcgggtggtataaaatggcggatttcgaagagttgaggaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttaggtaagtgtttgagaattcacaagaagaaagtagatgttattgatcttacaatagaaagctcttctgacgaagaggaagaccctcctgccaaaaggaaatgcatctttatgtcagaaacacaaagcagcccaaccaaaggggttctcatgtatcagccatcttctgtaagggtgcccagtgtgacttcggttgatcctgctgctattccgccttcattaacagactactcagtaccattccaccatacgccaatatcaagcatgtcatcagatttgccaggagaacaaagaagaaatgatattaataatgaactgaagcttggaacatcttctgatactgtgcaacagtgaatacaaaataaaacaaataatttgta

SEQ ID NO: 71615 - DNA, 1149 bp, Homo sapiens
aaattcatactggttagtagatattttaaatgtacccactgatattctctattttgcataaaagcataatgtcagactttctctgtgtggtggttatattcggggtgtctctgaatgccagcataaaaattcacggaattgaatagaaattggcctgtcttaatgacctatggtttcttttttaatgttttgaaataattaaagagagtttagtcacacagggaggtctaggtgaactgatgttgaagtttattactagacttttcagacctaaaaattttatttattgttattacttgaatatgtcaaaagtatattactggacaaccttttacacattcctctttctaaaatcgaattggacaattacagttctctggttcagaaaattacattagctcagaacccagtaacccttgataaccctgttagcgcagcaattcccgagtgtgtgctttgtgcagagcgttggactatgtactgctcttgatgtggggacagcggggacagagagctgtcattgaaatagacatctgtttaagaagcgatacttagatgaacctctgtatttctgaaaaataaatgtgaaatatcttaagagcttaagtatgtttttttttttagatggttcaaatccagatcattagctcatcatttttattgcttctcattctgttaagcggcaaagggggaaatatttgttttgactagtccttcactggaaagttttggacttctgcatttgagtctctgggagctagtttttccagttgttttatcagagaatatattcatctttgggttttaaacacttcaaatatcactgatcatggtatagaacttctctgtgacagagtggtaagcacttaccacaaatgttttgtgatttgtgataaagatgatttagggaaataattctggtctcccaaaatatgagacaactattaacaaagcatttttgttttaggtttggattttctttcccttattccagttgatccccaggtatgtatcctgaatttaagcaactaatttgtatttgattgttggttatgtcatactaactaaaaatgaccagttgcataaaatcaggacagtcatctctgaattacttacattgatggaaaggaagtactgtgcaaatatttc

SEQ ID NO: 71616 - DNA, 489 bp, Homo sapiens
agccagtattaacagttatggtgatactggttgttattattgaaaagctttcttaccagttgataactgaatagaataggatctattttgctttagaagaattgctagtttatcatcatgtatgaattatgtagcagttactatatctaaatagtttagttttactttgattttattgttaatgtgctcttttgtgattagtaatttggttttatttttatgcataatttttatgtagttagtcatactgtgaagagttttggtattgataaacttaataatttataataaaatattaaatagaacaccaagaatggagagataacaaagttttaatacatttcttaacattccttttaaacatcataaacatgaatcttctgaatctgcaggagaacaaagaagaaatgatattaataatgaactgaagcttggaacatcttctgatactgtgcaacagtgaatacaaaataaaacaaataatttgta

SEQ ID NO: 71617 - DNA, 338 bp, Homo sapiens
atacctttaaaatgattgagcttttattttcagtgaagtagcttggtgaattttgtccccttcgcagtgattgaccattccatggaagttattttgaatgttatttttagaaaccagagtttcttaaataagtatttcatgtaaacaaagagaatattatctctcatctttaatgcaggttttttttgtttgtttgtagaattactctatgtctgtatatcttgtacggcagcttacatcagccatgttattacagagattaaaaatgaaaggtattagaaaccctgatcattccagagcactaagtaagtaatgtttaataagaccaagcatttaaa

SEQ ID NO: 71618 - DNA, 1939 bp, Homo sapiens
agcggggcggaggcggagctcccgcgccgttcacgtgacgggcccggctgtagcggcggcggccgcggcgtcttaagcggcgcccagtgcaggatggtgctggaggcggcggcggccgtggtggcggcagcgtcgttggcggcagcgggagtgggtgcggcggcagcggcggcggcgcccgcgggtggtataaaatggcggatttcgaagagttgaggaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttagttcaaagcagtattcagcgatttcaagagaagttttttatttttgctttgacacctcaacaagttagagagatatgcatatccagggattttttgccaggtggtaggagagattatacagtccaagttcagttgagactttgcctggcagagacaagttgccctcaagaagataactatccaaatagtctatgtataaaagtaaatgggaagctatttcctttgcctggctatgcaccaccgcctaaaaatgggattgaacagaagcgccctggacgccccttgaatattacatctttagttaggttatcttcagctgtgccaaaccaaatttccatttcttgggcatcagaaattgggaagaattactctatgtctgtatatcttgtacggcagcttacatcagccatgttattacagagattaaaaatgaaaggtattagaaaccctgatcattccagagcactaattaaagaaaaacttactgcagatcctgatagtgaaattgctacaactagccttcgggtatccttgatgtgccctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggctttttatggaaattctcaatgactgttctgatgtagatgagatcaaattccaagaagatggttcttggtgtccaatgagaccgaagaaagaagctatgaaagtatccagccaaccgtgtacaaaaatagaaagttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaaggggttctcatgtatcagccatcttctgtaagggtgcccagtgtgacttcggttgatcctgctgctattccgccttcattaacagactactcagtaccattccaccatacgccaatatcaagcatgtcatcagatttgccaggagaacaaagaagaaatgatattaataatgaactgaagcttggaacatcttctgatactgtgcaacagtgaatacaaaataaaacaaataatttgta

SEQ ID NO: 71619 - DNA, 4436 bp, Homo sapiens
agcggggcggaggcggagctcccgcgccgttcacgtgacgggcccggctgtagcggcggcggccgcggcgtcttaagcggcgcccagtgcaggatggtgctggaggcggcggcggccgtggtggcggcagcgtcgttggcggcagcgggagtgggtgcggcggcagcggcggcggcgcccgcgggtggtataaaatggcggatttcgaagagttgaggaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttagttcaaagcagtattcagcgatttcaagagaagttttttatttttgctttgacacctcaacaagttagagagatatgcatatccagggattttttgccaggtggtaggagagattatacagtccaagttcagttgagactttgcctggcagagacaagttgccctcaagaagataactatccaaatagtctatgtataaaagtaaatgggaagctatttcctttgcctggctatgcaccaccgcctaaaaatgggattgaacagaagcgccctggacgccccttgaatattacatctttagttaggttatcttcagctgtgccaaaccaaatttccatttcttgggcatcagaaattgggaagaattactctatgtctgtatatcttgtacggcagcttacatcagccatgttattacagagattaaaaatgaaaggtattagaaaccctgatcattccagagcactaattaaagaaaaacttactgcagatcctgatagtgaaattgctacaactagccttcgggtatccttgatgtgccctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggctttttatggaaattctcaatgactgttctgatgtagatgagatcaaattccaagaagatggttcttggtgtccaatgagaccgaagaaagaagctatgaaagtatccagccaaccgtgtacaaaaatagaaagttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaaggggttctcatgtatcagccatcttctgtaagggtgcccagtgtgacttcggttgatcctgctgctattccgccttcattaacagactactcagtaccattccaccatacgccaatatcaagcatgtcatcagatttgccaggtttggattttctttcccttattccagttgatccccagcagtactgtcctcctatgtttttggatagtctcacctcacccttaacagcaagcagtacgtctgtcaccaccaccagctcccatgaaagcagtactcatgttagttcatccagcagcaggagtgagacaggggtcataaccagcagtggaagtaacattcctgacatcatctcattggactaaaggaggactcacttgattctgggaatcattcatcagaactgctttttcttggatctctagtctgtggaaacgttcttttttttttttttttaataatttggtatttattgaaagtcagatggattcttttgctttctgaggggtgaacacagaagactgcaacaagaaccaaatgacatgcaaggatttttcttaattatgctgtactctcagcatcagatacattcaaccataactgtatcttcctgagagatggatttcactttcatacgttaatggatggagtctacaaatcagtgaaaaaagtttttgttaaaataaagagcaataaaattatgtaaatattcaagtaaccttttttctaattaaaaaaaaaattgtaatcactgattctagaatgacagcaacttctgtttaaccttacgtgaaggaaaaaaaatatatggaaagaacttaatgtttgctgaatgagtcctttccatggagatttgctctgtttcattgaagtaatgaagtttcagtacgtggccaaagcttggattccacttttcgtcctgcatttccacttttcttcgtgattgcatcaaagaaaaatggcattcgtgttacttggtttttttcctgcttatcatttacactttgacgttgtttgctaatgagtgctgtgtgaagttctgggatttggctactcttcattggtgattatgtttaaaagcactatgcagattctgccctgacataaagtgtgttattatgtttttagtaattgtacatttttcattctagagttttctataaatttgaggcttgccttctcaaaaaagaaactatgcagccattgaatgaaatgtctttggggtacggtgtgactggaatgtttgttagaaatttgttcacactatcaaatattgatatcttggagccagcagaagagcagattttgggaggtggtaataacaaaatttaatttcttcccaacaacttaattttctcatttattttacagaatagtagtgaaatatttgatgaaactttgtattttggtagcactacatagaaaatgtgttttagatttatgatgatcatatttctcaccaatgtaatttcagtctcagcagtgattttcaaacttagggaaagggacagcattagatttttttttttttcatttttttaaaatgatatcttacctgaaactacaaacgacaaaagagaattagaaatgtttgaattaaagtgaagaagggttgggggagatgggcctgaacccacttcctgtctcaatccatgctaccccaaacactccagggaacctctgaggttttattgggtgcactttgaaaatttctcttctatagtgtgtttgtttgattttaaatcacagagaaaactgggttttactcttagagaaacattttcatccagttttttagtttgcttcatttgacttcctaaatcatttttgagttcacaaggatttggtacttttctgtttagctttctctctctaagctttatctaccttaaaaacaaagtcctttttttaatggccagtccaaccaattgatttctcaaactgaagtgcccaggtgtggactcatcaatttccgttagaatagggacatcctacttaagagttggtgcagctccaaggagctgacttgtccttgcttggggttttttttttttttcacccttctcaagtttccatggcctttgtgtgttctttttatgttgatttaaattcatatggttttccacaaatcccttctttggctacattgtctccttattcaatggattatccctttgtgggggctgcttattttaaagatgttgggggggaaacaaacccaaatctacgagcagtagttgcacatagttgccagttttaccttcttagtcattagatttccaaaccatgttgcagttttttggtccagatatagtatttctttctaataaagttttatgttgctgctctaaatacagatgcaatatttattgactctgtaatcagatagaaaaaacttaacttggtttgtgtggtatgacttataaagaaatgatgtatatttgttattttgttaccctttagattgtcagagactcccccaatttaatcaacaaagttttataaagtaaatgaaaatattaatagaaattagtttatttacttggttcttataactgatatctctgtgcttttataattgtgatttgtttttttgtttttttttctattttctgtgaacagttttaatgttcggttttggtgttttacactgaaattacatataaatttttaatttatttcatacaggcaacttgcattttaaaaaatacactttgaagtttatcatcttgaaattg

SEQ ID NO: 71620 - DNA, 3470 bp, Homo sapiens
  misc_feature (3412)..(3412): n is a, c, g, or t
agcggggcggaggcggagctcccgcgccgttcacgtgacgggcccggctgtagcggcggcggccgcggcgtcttaagcggcgcccagtgcaggatggtgctggaggcggcggcggccgtggtggcggcagcgtcgttggcggcagcgggagtgggtgcggcggcagcggcggcggcgcccgcgggtggtataaaatggcggatttcgaagagttgaggaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttagttcaaagcagtattcagcgatttcaagagaagttttttatttttgctttgacacctcaacaagttagagagatatgcatatccagggattttttgccaggtggtaggagagattatacagtccaagttcagttgagactttgcctggcagagacaagttgccctcaagaagataactatccaaatagtctatgtataaaagtaaatgggaagctatttcctttgcctggctatgcaccaccgcctaaaaatgggattgaacagaagcgccctggacgccccttgaatattacatctttagttaggttatcttcagctgtgccaaaccaaatttccatttcttgggcatcagaaattgggaagaattactctatgtctgtatatcttgtacggcagcttacatcagccatgttattacagagattaaaaatgaaaggtattagaaaccctgatcattccagagcactaattaaagaaaaacttactgcagatcctgatagtgaaattgctacaactagccttcgggtatccttgatgtgccctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggctttttatggaaattctcaatgactgttctgatgtagatgagatcaaattccaagaagatggttcttggtgtccaatgagaccgaagaaagaagctatgaaagtatccagccaaccgtgtacaaaaatagaaagttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaaggggttctcatgtatcagccatcttctgtaagggtgcccagtgtgacttcggttgatcctgctgctattccgccttcattaacagactactcagtaccattccaccatacgccaatatcaagcatgtcatcagatttgccaggtttggattttctttcccttattccagttgatccccagcagtactgtcctcctatgtttttggatagtctcacctcacccttaacagcaagcagtacgtctgtcaccaccaccagctcccatgaaagcagtactcatgttagttcatccagcagcaggagtgagacaggggtcataaccagcagtggaagtaacattcctgacatcatctcattggactaaaggaggactcacttgattctgggaatcattcatcagaactgctttttcttggatctctagtctgtggaaacgttcttttttttttttttttaataatttggtatttattgaaagtcagatggattcttttgctttctgaggggtgaacacagaagactgcaacaagaaccaaatgacatgcaaggatttttcttaattatgctgtactctcagcatcagatacattcaaccataactgtatcttcctgagagatggatttcactttcatacgttaatggatggagtctacaaatcagtgaaaaaagtttttgttaaaataaagagcaataaaattatgtaaatattcaagtaaccttttttctaattaaaaaaaaaattgtaatcactgattctagaatgacagcaacttctgtttaaccttacgtgaaggaaaaaaaatatatggaaagaacttaatgtttgctgaatgagtcctttccatggagatttgctctgtttcattgaagtaatgaagtttcagtacgtggccaaagcttggattccacttttcgtcctgcatttccacttttcttcgtgattgcatcaaagaaaaatggcattcgtgttacttggtttttttcctgcttatcatttacactttgacgttgtttgctaatgagtgctgtgtgaagttctgggatttggctactcttcattggtgattatgtttaaaagcactatgcagattctgccctgacataaagtgtgttattatgtttttagtaattgtacatttttcattctagagttttctataaatttgaggcttgccttctcaaaaaagaaactatgcagccattgaatgaaatgtctttggggtacggtgtgactggaatgtttgttagaaatttgttcacactatcaaatattgatatcttggagccagcagaagagcagattttgggaggtggtaataacaaaatttaatttcttcccaacaacttaattttctcatttattttacagaatagtagtgaaatatttgatgaaactttgtattttggtagcactacatagaaaatgtgttttagatttatgatgatcatatttctcaccaatgtaatttcagtctcagcagtgattttcaaacttagggaaagggacagcattagatttttttttttttcatttttttaaaatgatatcttacctgaaactacaaacgacaaaagagaattagaaatgtttgaattaaagtgaagaagggttgggggagatgggcctgaacccacttcctgtctcaatccatgctaccccaaacactccagggaacctctgaggttttattgggtgcacttggttcatttanaggaccattttcatccatttttaggttgttaattgacttcctaaacattttgaaggca

SEQ ID NO: 71621 - DNA, 2299 bp, Homo sapiens
agcggggcggaggcggagctcccgcgccgttcacgtgacgggcccggctgtagcggcggcggccgcggcgtcttaagcggcgcccagtgcaggatggtgctggaggcggcggcggccgtggtggcggcagcgtcgttggcggcagcgggagtgggtgcggcggcagcggcggcggcgcccgcgggtggtataaaatggcggatttcgaagagttgaggaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttagttcaaagcagtattcagcgatttcaagagaagttttttatttttgctttgacacctcaacaagttagagagatatgcatatccagggattttttgccaggtggtaggagagattatacagtccaagttcagttgagactttgcctggcagagacaagttgccctcaagaagataactatccaaatagtctatgtataaaagtaaatgggaagctatttcctttgcctggctatgcaccaccgcctaaaaatgggattgaacagaagcgccctggacgccccttgaatattacatctttagttaggttatcttcagctgtgccaaaccaaatttccatttcttgggcatcagaaattgggaagaattactctatgtctgtatatcttgtacggcagcttacatcagccatgttattacagagattaaaaatgaaaggtattagaaaccctgatcattccagagcactaattaaagaaaaacttactgcagatcctgatagtgaaattgctacaactagccttcgggtatccttgatgtgccctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggctttttatggaaattctcaatgactgttctgatgtagatgagatcaaattccaagaagatggttcttggtgtccaatgagaccgaagaaagaagctatgaaagtatccagccaaccgtgtacaaaaatagaaagttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaaggggttctcatgtatcagccatcttctgtaagggtgcccagtgtgacttcggttgatcctgctgctattccgccttcattaacagactactcagtaccattccaccatacgccaatatcaagcatgtcatcagatttgccaggagaacaaagaagaaatgatattaataatgaactgaagcttggaacatcttctgatactgtgcaacagtgaatacaaaataaaacaaataatttgtaaaaaaaaaaaaaaaaaaaaaaaaaattaaaaaaaaaaaaaaaaaaaaaaaaagcaaaaaaagaaaaaaaaaaaaacaaagaaaatacaaaaagaaaagaggagggggcggggcgcgcctacaaaaatcacccccgccggggggggacgcagcacttgactaagcccacccccgcgtgttcgtgagcaaggggggcccccataatgagggagcgcgcatataaacaaaaacgacggcgaggcgcggccgcttaaaacaaacgcgggcggaggggggaaaacacgatcccgcggggcgaccctcgtggagagaaacaccccacacccgggggggggcaccacagtgggcgaccaacgcccac

SEQ ID NO: 71622 - DNA, 1796 bp, Homo sapiens
agcggggcggaggcggagctcccgcgccgttcacgtgacgggcccggctgtagcggcggcggccgcggcgtcttaagcggcgcccagtgcaggatggtgctggaggcggcggcggccgtggtggcggcagcgtcgttggcggcagcgggagtgggtgcggcggcagcggcggcggcgcccgcgggtggtataaaatggcggatttcgaagagttgaggaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttagttcaaagcagtattcagcgatttcaagagaagttttttatttttgctttgacacctcaacaagttagagagatatgcatatccagggattttttgccaggtggtaggagagattatacagtccaagttcagttgagactttgcctggcagagacaagttgccctcaagaagataactatccaaatagtctatgtataaaagtaaatgggaagctatttcctttgcctggctatgcaccaccgcctaaaaatgggattgaacagaagcgccctggacgccccttgaatattacatctttagttaggttatcttcagctgtgccaaaccaaatttccatttcttgggcatcagaaattgggaagaattactctatgtctgtatatcttgtacggcagcttacatcagccatgttattacagagattaaaaatgaaaggtattagaaaccctgatcattccagagcactaattaaagaaaaacttactgcagatcctgatagtgaaattgctacaactagccttcgggtatccttgatgtgccctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggctttttatggaaattctcaatgactgttctgatgtagatgagatcaaattccaagaagatggttcttggtgtccaatgagaccgaagaaagaagctatgaaagtatccagccaaccgtgtacaaaaatagaaagttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaagggtttgttaatttatagttcactattgttcattacccttgcaactaattgctcttggatagatttataaatgtctctttgggaaatggcataact

SEQ ID NO: 71623 - DNA, 3244 bp, Homo sapiens
ttcaactttctacgcaactagcttcgggtatcttgatgtgcctttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggctttttatggaaattctcaatgactgttctgatgtagatgagatcaaattccaagaagatggttcttggtgtccaatgagaccgaagaaagaagctatgaaagtatccagccaaccgtgtacaaaaatagaaagttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaaggggttctcatgtatcagccatcttctgtaagggtgcccagtgtgacttcggttgatcctgctgctattccgccttcattaacagactactcagtaccattccaccatacgccaatatcaagcatgtcatcagatttgccaggtttggattttctttcccttattccagttgatccccagcagtactgtcctcctatgtttttggatagtctcacctcacccttaacagcaagcagtacgtctgtcaccaccaccagctcccatgaaagcagtactcatgttagttcatccagcagcaggagtgagacaggggtcataaccagcagtggaagtaacattcctgacatcatctcattggactaaaggaggactcacttgattctgggaatcattcatcagaactgctttttcttggatctctagtctgtggaaacgttcttttttttttttttttaataatttggtatttattgaaagtcagatggattcttttgctttctgaggggtgaacacagaagactgcaacaagaaccaaatgacatgcaaggatttttcttaattatgctgtactctcagcatcagatacattcaaccataactgtatcttcctgagagatggatttcactttcatacgttaatggatggagtctacaaatcagtgaaaaaagtttttgttaaaataaagagcaataaaattatgtaaatattcaagtaaccttttttctaattaaaaaaaaaattgtaatcactgattctagaatgacagcaacttctgtttaaccttacgtgaaggaaaaaaaatatatggaaagaacttaatgtttgctgaatgagtcctttccatggagatttgctctgtttcattgaagtaatgaagtttcagtacgtggccaaagcttggattccacttttcgtcctgcatttccacttttcttcgtgattgcatcaaagaaaaatggcattcgtgttacttggtttttttcctgcttatcatttacactttgacgttgtttgctaatgagtgctgtgtgaagttctgggatttggctactcttcattggtgattatgtttaaaagcactatgcagattctgccctgacataaagtgtgttattatgtttttagtaattgtacatttttcattctagagttttctataaatttgaggcttgccttctcaaaaaagaaactatgcagccattgaatgaaatgtctttggggtacggtgtgactggaatgtttgttagaaatttgttcacactatcaaatattgatatcttggagccagcagaagagcagattttgggaggtggtaataacaaaatttaatttcttcccaacaacttaattttctcatttattttacagaatagtagtgaaatatttgatgaaactttgtattttggtagcactacatagaaaatgtgttttagatttatgatgatcatatttctcaccaatgtaatttcagtctcagcagtgattttcaaacttagggaaagggacagcattagatttttttttttttcatttttttaaaatgatatcttacctgaaactacaaacgacaaaagagaattagaaatgtttgaattaaagtgaagaagggttgggggagatgggcctgaacccacttcctgtctcaatccatgctaccccaaacactccagggaacctctgaggttttattgggtgcactttgaaaatttctcttctatagtgtgtttgtttgattttaaatcacagagaaaactgggttttactcttagagaaacattttcatccagttttttagtttgcttcatttgacttcctaaatcatttttgagttcacaaggatttggtacttttctgtttagctttctctctctaagctttatctaccttaaaaacaaagtcctttttttaatggccagtccaaccaattgatttctcaaactgaagtgcccaggtgtggactcatcaatttccgttagaatagggacatcctacttaagagttggtgcagctccaaggagctgacttgtccttgcttggggttttttttttttttcacccttctcaagtttccatggcctttgtgtgttctttttatgttgatttaaattcatatggttttccacaaatcccttctttggctacattgtctccttattcaatggattatccctttgtgggggctgcttattttaaagatgttgggggggaaacaaacccaaatctacgagcagtagttgcacatagttgccagttttaccttcttagtcattagatttccaaaccatgttgcagttttttggtccagatatagtatttctttctaataaagttttatgttgctgctctaaatacagatgcaatatttattgactctgtaatcagatagaaaaaacttaacttggtttgtgtggtatgacttataaagaaatgatgtatatttgttattttgttaccctttagattgtcagagactcccccaatttaatcaacaaagttttataaagtaaatgaaaatattaatagaaattagtttatttacttggttcttataactgatatctctgtgcttttataattgtgatttgtttttttgtttttttttctattttctgtgaacagttttaatgttcggttttggtgttttacactgaaattacatataaatttttaatttatttcatacaggcaacttgcattttaaaaaatacactttgaagtttatcatcttgaaattg

SEQ ID NO: 71624 - DNA, 1132 bp, Homo sapiens
agcggggcggaggcggagctcccgcgccgttcacgtgacgggcccggctgtagcggcggcggccgcggcgtcttaagcggcgcccagtgcaggatggtgctggaggcggcggcggccgtggtggcggcagcgtcgttggcggcagcgggagtgggtgcggcggcagcggcggcggcgcccgcgggtggtataaaatggcggatttcgaagagttgaggaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttagttcaaagcagtattcagcgatttcaagagaagttttttatttttgctttgacacctcaacaagttagagagatatgcatatccagggattttttgccaggtggtaggagagattatacagtccaagttcagttgagactttgcctggcagagacaagttgccctcaagaagataactatccaaatagtctatgtataaaagtaaatgggaagctatttcctttgcctgttcccttggtgcaaggaagacagcagctcatagtagggcttgtgggatggtgacatgcagtgtggacagacaagaacctgctgcagagaccatctcccatctttgactccaagggctgccagtgtacagactgacagccagatgagaacattccatgtttttaatgggcagaagaaagaaaaaggccctctttgtttagggagttatttta

SEQ ID NO: 71625 - DNA, 638 bp, Homo sapiens
ggatgataaaggagaaatgctttggtttaagagagggaaatctttgttaccaatactatcggtgagttcacctaatacttcctcgtcatcaagttcattggagtacgcatcttcttcatcctcatctcccggttcagtgggttcacttttgacagggcactccccgtttgggtgtaaaacgttgctttcttttggcctttcacagttgttctcttggtctttgctctctgacatcttgctagactcagacgatgagtggctgagggagacagaggtaattggggtgttcactactaaactagacagcccccccagattcacttcagcctttggcatttgggtaatccccagcggctgctctgctgagctcgaggtgctcgcgcttccttttaagaaggcaaagccagccggcaaagagtcaccattttcaacatgaaaagcgctccataaaccgcggaaggttggatcgggtcctatgaggtttgtagtagaaaaatggggataaacagaagtggatttttttggttccagaaagcttataagaggttctttgtctttgccaatcccctgtattatggcggagacgcatttattactgaggagcttctgctcctcgtcattgagggtcatccgatgat

SEQ ID NO: 71626 - DNA, 332 bp, Homo sapiens
ggattggaacttagaaaaaatccccagaaatcagaaatactggactgagaaagcctagatcctcattttcaaggtaccctaactaaggaaaatatcctacccctaccctcacctctgaagtttgtgtcttcccaaagaaggagggagtttaacaggaagtcaagaacaatcacattaaaaacaggctaaacaaataccagtagcaactgattcttcttggaaacagtggttgtagattatatatcactgcttttgaaatctaagtgcatatcaatatctaggtagtttttcaaaaaattcaggtgcctaggctcaccctagatccactccca

SEQ ID NO: 71627 - DNA, 484 bp, Homo sapiens
  misc_feature (1)..(1): n is a, c, g, or t
nggcaataccaagattttcttgaagatcttgaagaagatgaggcaattcgaaaaaatgtcaacatttacagagattcagccatccctgtggaaagtgacaccgatgatgaaggagcacctcgaattagtctggctgagatgcttgaagaccttcatatttcccaagatgccactggtgaagaaggtgcatcaatgctgacataatgagatgttgcaggcgtgacacgctcacgtggcccccctgtcttttgaggacaatacttaaggctcagtcctctgctctcttttccttgataacttttctttaaaccacttcatctgcttttttaatttaacttcatgggtaactcacagttccacatctcagacccaaacctcacttggaatcccaagtctgtgtcttcattagctaccagctagctagtttctcttgattgcctgcaacaccttttccatgtctacatgttctttgtcccaaaataag

SEQ ID NO: 71628 - DNA, 1014 bp, Homo sapiens
cggacgcgtgggtccgccgagctacgggtgccgggtggagcgaagcacggaatgtgtctcctgctgggggccacgggcgtcgggaagacgctgctggtgaaacggctgcaggaggtgagctcccgggatgggaaaggcgacctgggggagccgcccccgacacggcccacggtgggcaccaatcttactgacatcgtggcacagagaaagatcaccatccgggagcttggggggtgcatgggccccatctggtccagttactatggaaactgccgttctctcctgtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattgactgcacggcagaggcgcagctggcctgagctggggagaggtggcagagggcagtatggctttgctgccaatagtttcttctcacaggggcagaataacccaaagtaaccctacatgatggggctctgtgctgagatgcaatgatgtgtaaactgaggcatgtggagatggaagttgacatctggcctctgaaaaaagtgtccccaggggctaggcatggtggctcacacctgtaatcccagcactttgagaggccgaggcgggtgtatcacctgaggtcgggagttcgagactagcctgaccaacatgggaaccatgtctaaaaatccagaattagctgggtgtgctagcacatgcctgtaatcccagctacttgagaggctgagacaggagaaccccttgaacccaggaagcggaggttgcagtgagccaagatcacgcc

SEQ ID NO: 71629 - DNA, 850 bp, Homo sapiens
  misc_feature (51)..(51): n is a, c, g, or t
gggctgagagcgcgggaacggcgtggatatcttccgcgcggggacgggacnggggcgcggggggcaccggagtggggcggggactcaccctttactgctcgggtccttgaccgcttcgcactttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattgactgcacggcagaggcgcagctggcctgagctggggagaggtggcagagggcagtatggctttgctgccaatagtttcttctcacaggggcagaataacccaaagtaaccctacatgatggggctctgtgctgagatgcaatgatgtgtaaactgaggcatgtggagatggaagttgacatctggcctctgaaaaaagtgtccccaggggctaggcatggtggctcacacctgtaatcccagcactttgagaggccgaggcgggtgtatcacctgaggtcgggagttcgagactagcctgaccaacatgggaaccatgtctaaaaatccagaattagctgggtgtgctagcacatgcctgtaatcccagctacttgagaggctgagacaggagaaccccttgaacccaggaagcggaggttgcagtgagccaagatcacgcc

SEQ ID NO: 71630 - DNA, 491 bp, Homo sapiens
cccctgtttactgaggtgactctagacgatccccttactaacactatgcaactaaggcagctgtgatgtcagaattggaatggggagaggtggcagagggcagtatggctttgctgccaatagtttcttctcacaggggcagaataacccaaagtaaccctacatgatggggctctgtgctgagatgcaatgatgtgtaaactgaggcatgtggagatggaagttgacatctggcctctgaaaaaagtgtccccaggggctaggcatggtggctcacacctgtaatcccagcactttgagaggccgaggcgggtgtatcacctgaggtcgggagttcgagactagcctgaccaacatgggaaccatgtctaaaaatccagaattagctgggtgtgctagcacatgcctgtaatcccagctacttgagaggctgagacaggagaaccccttgaacccaggaagcggaggttgcagtgagccaagatcacgcc

SEQ ID NO: 71631 - DNA, 943 bp, Homo sapiens
  misc_feature (9)..(9): n is a, c, g, or t
cgggcgttngaaaaagagtgcctgggtgaaacggctgcaggaggtgagctcccgggatgggaaaggcgacctgggggagccgcccccgacacggcccacggtgggcaccaatcttactgacatcgtggcacagagaaagatcaccatccgggagcttggggggtgcatgggccccatctggtccagttactatggaaactgccgttctctcctgtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattgactgcacggcagaggcgcagctggcctgagctggggagaggtggcagagggcagtatggctttgctgccaatagtttcttctcacaggggcagaataacccaaagtaaccctacatgatggggctctgtgctgagatgcaatgatgtgtaaactgaggcatgtggagatggaagttgacatctggcctctgaaaaaagtgtccccaggggctaggcatggtggctcacacctgtaatcccagcactttgagaggccgaggcgggtgtatcacctgaggtcgggagttcgagactagcctgaccaacatgggaaccatgtctaaaaatccagaattagctgggtgtgctagcacatgcctgtaatcccagctacttgagaggctgagacaggagaaccccttgaacccaggaagcggaggttgcagtgagccaagatcacgcc

SEQ ID NO: 71632 - DNA, 833 bp, Homo sapiens
caaaaaaaaaaatgcagttttgctctcccagtgccaggtcagtgaggcccaggggaggaagtttggcagcagggcgttgctgccatctttttctttttccccagtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattgactgcacggcagaggcgcagctggcctgagctggggagaggtggcagagggcagtatggctttgctgccaatagtttcttctcacaggggcagaataacccaaagtaaccctacatgatggggctctgtgctgagatgcaatgatgtgtaaactgaggcatgtggagatggaagttgacatctggcctctgaaaaaagtgtccccaggggctaggcatggtggctcacacctgtaatcccagcactttgagaggccgaggcgggtgtatcacctgaggtcgggagttcgagactagcctgaccaacatgggaaccatgtctaaaaatccagaattagctgggtgtgctagcacatgcctgtaatcccagctacttgagaggctgagacaggagaaccccttgaacccaggaagcggaggttgcagtgagccaagatcacgcc

SEQ ID NO: 71633 - DNA, 1023 bp, Homo sapiens
  misc_feature (51)..(51): n is a, c, g, or t
gggctgagagcgcgggaacggcgtggatatcttccgcgcggggacgggacnggggcgcggggggcaccggagtggggcggggactcaccctttactgctcgggtccttgaccgcttcgcacaggtgagctcccgggatgggaaaggcgacctgggggagccgcccccgacacggcccacggtgggcaccaatcttactgacatcgtggcacagagaaagatcaccatccgggagcttggggggtgcatgggccccatctggtccagttactatggaaactgccgttctctcctgtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattgactgcacggcagaggcgcagctggcctgagctggggagaggtggcagagggcagtatggctttgctgccaatagtttcttctcacaggggcagaataacccaaagtaaccctacatgatggggctctgtgctgagatgcaatgatgtgtaaactgaggcatgtggagatggaagttgacatctggcctctgaaaaaagtgtccccaggggctaggcatggtggctcacacctgtaatcccagcactttgagaggccgaggcgggtgtatcacctgaggtcgggagttcgagactagcctgaccaacatgggaaccatgtctaaaaatccagaattagctgggtgtgctagcacatgcctgtaatcccagctacttgagaggctgagacaggagaaccccttgaacccaggaagcggaggttgcagtgagccaagatcacgcc

SEQ ID NO: 71634 - DNA, 909 bp, Homo sapiens
cggacgcgtgggtccgccgagctacgggtgccgggtggagcgaagcacggaatgtgtctcctgctgggggccacgggcgtcgggaagacgctgctggtgaaacggctgcaggaggtgagctcccgggatgggaaaggcgacctgggggagccgcccccgacacggcccacggtgggcacctttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattgactgcacggcagaggcgcagctggcctgagctggggagaggtggcagagggcagtatggctttgctgccaatagtttcttctcacaggggcagaataacccaaagtaaccctacatgatggggctctgtgctgagatgcaatgatgtgtaaactgaggcatgtggagatggaagttgacatctggcctctgaaaaaagtgtccccaggggctaggcatggtggctcacacctgtaatcccagcactttgagaggccgaggcgggtgtatcacctgaggtcgggagttcgagactagcctgaccaacatgggaaccatgtctaaaaatccagaattagctgggtgtgctagcacatgcctgtaatcccagctacttgagaggctgagacaggagaaccccttgaacccaggaagcggaggttgcagtgagccaagatcacgcc

SEQ ID NO: 71635 - DNA, 966 bp, Homo sapiens
cggacgcgtgggtccgccgagctacgggtgccgggtggagcgaagcacggaatgtgtctcctgctgggggccacgggcgtcgggaagacgctgctggtgaaacggctgcaggaggtgagctcccgggatgggaaaggcgacctgggggagccgcccccgacacggcccacggtgggcaccaatcttactgacatcgtggcacagagaaagatcaccatccgggagcttggggggtgcatgggccccatctggtccagttactatggaaactgccgttctctcctgtttgtgatggacgcctctgaccccacccagctctctgcatcctgtgtgcagctcttaggtctcctttctgcagaacaacttgcagaagcatcggtgctgatactcttcaataaaatgcttccagacatcattgcttgtgccaagcagaacatcaccacggcagaaatcagcgcccgtgaaggcactggcttagcaggggtgctggcctggctccaggccacccacagagccaacgattgactgcacggcagaggcgcagctggcctgagctggggagaggtggcagagggcagtatggctttgctgccaatagtttcttctcacaggggcagaataacccaaagtaaccctacatgatggggctctgtgctgagatgcaatgatgtgtaaactgaggcatgtggagatggaagttgacatctggcctctgaaaaaagtgtccccaggggctaggcatggtggctcacacctgtaatcccagcactttgagaggccgaggcgggtgtatcacctgaggtcgggagttcgagactagcctgaccaacatgggaaccatgtctaaaaatccagaattagctgggtgtgctagcacatgcctgtaatcccagctacttgagaggctgagacaggagaaccccttgaacccaggaagcggaggttgcagtgagccaagatcacgcc

SEQ ID NO: 71636 - DNA, 683 bp, Homo sapiens
taaatgccatgcacaaattacttcatttaatttccataacatctacaaaataagttatataattaaagccattttacagatgaaaaatctaggcagaaggatgttaagtaactaaggtcacacagctggtgaatggaagagcagagtcttgaacccagaagccatagcttcaaggtccatgctcagaaccagtattccacactgtcttcactacgtcaaatgggaacagtgataataacatccacacaagggtgttgtgaagattaaatgagttaatgcacgtaaagggccaggcccccagttagaggtagatcctcatggtgattaacaatgcagcctgacaggctcccatcattcactggctgtgtgaacttgggcaagttactgacccttactaggcctgttttcttctctggaaaatgaagatgaaaacagtaactctaccctacatggttgtaagaaattaataagacaatacctgttaagtgcttagcacagggcctggcatatagtaaattctcaagagattttgaggtctgtttttaattattaataagttctcactaaagttagattccttctcagacaccttccactgatcaaagagtctcatcaaagcaagttcttccctccctggtcccctttggctttctgaaatcattaattaaaagaaaggccctagg

SEQ ID NO: 71637 - DNA, 433 bp, Homo sapiens
ttgtgccacagctttccaccctgggcgatggagacagactcatctcaacaacaacaacaacaacaacaacgaaaaggaatcaagtattgatacattctacaatgtgaatgaaccttgaaaacattatttgagtgaaagaagccagatataaaatgccacatattgtatgattccatgcacatgaaatgtctccaatgggcaaatccgtagagccagaaagtagattagtggttgccaggagctatgaggaggagaggactgctaatgcatacagagtttccttctggaatgatgaaagtgttctgaattagatagtagtgatagttgcccagctttgacaatagagtaaaaaccattgaatgctactgtttacagtggtggatttttatgtatattataactcaataaaaagatgatctaatccatggaaaat

SEQ ID NO: 71638 - DNA, 660 bp, Homo sapiens
ggtccttgaagccagacttaggtaccgtttctttcatcccttgctagttcctaatcgtagacacaaaccttccacatccatccaggcggatggcagtgcttcttgtagaaagcaatgtcactaaggcagtgtcactaagggaaacaggacaaggcaacagttgtgttcagagttttgactggcgtctgattggaattagaaggaagattattttgcccataacctaggtaccgtgaccccaagctccttttggcaagacccttgaacgtccacaaaacccgtaacgccttgcctggaagaaagggaaaaaggagagttgcagcccacctaagagagtcaaaggctgtggcctgcctggtggtgttttataggaactggctcagggaggctgcatgtcctttgttttctgaggccttgttcccacgtggcctcccacttgaggcccaggaatattgcagcaatgccgaagagtgggtggacaaatagccttattattaacctaagttggaaacatggctttttgagtgtcttcattcacagatgcagtcacaaaatattaatactctttttttgaacatgacaaaacaaagtattcatttaaacctcctttgtccacgtccatggtaaaagagcacctcaggcaggggagaaaaaaaaaaa

SEQ ID NO: 71639 - DNA, 437 bp, Homo sapiens
aatttagtgttatccatttgattcctgattcagaaatatcaataaaatcctatgttaaattaatctttaccaaaaacaggcaagttaactctgttgttttaattcaacagtccaacattatttaggtgttacagagtgtaaatatatttctttgggagttattttctttttaaaatctttttatagcttggcaatgtccaaagtcaaatatcacctaaactggttagattacttctacagctaataatattgcaggcactggcgccctctggtggttatgaagacaaattcttaatggctacttgacctacagcaaaagccatttctgtaccataaaaatttgttgtgcaatattagaattatcatatgtttcctacatctgacagcacctaaaatgtttgataatattaacatgtatctaagaggaaaaaagagtt

SEQ ID NO: 71640 - DNA, 3320 bp, Homo sapiens
tgcggggcggggcgtgggccaagcggcccgcaggaggcggcggcggccgttcagtcttgttgttccccgccgccgccgtcgctgacccagcccgccaggcgctcctgaccgtcgcttcctccggtcccaggtccccggccctcgcctcagccccggcccctggtccccagccctcgtcgcagccccggccgcccgccgccgccatgtccaaggaggagcgccccggtcgggaggagatcctggagtgccaggtgatgtgggagcctgacagtaagaagaacacgcagatggaccgcttccgggcggctgtgggcgccgcctgcggcctggcgctggagagttatgatgacttgtaccattggtccgttgagtcatattcagacttctgggcagagttctggaaattcagtggaattgtcttctcacgtgtgtatgatgaggttgtggacacatcgaaaggaatcgcagatgtccccgagtggttcaaaggcagtcggctcaactatgcagaaaacctcctgcggcacaaagagaatgacagagttgccctttacattgcaagggaaggcaaagaggaaattgtgaaggtgacttttgaagagctgaggcaagaagtggctttgtttgcagcagcaatgaggaaaatgggtgtgaagaaaggagatcgggttgttggttatttacccaacagtgagcacgctgtcgaggcgatgctggctgcggcaagcattggtgccatctggagctccacgtccccggacttcggtgtgaatggtgtgctggaccggttttctcaaattcagccaaagctcatcttctctgtggaggctgttgtctataatggcaaagagcacaaccacatggaaaagctgcagcaggtggttaaaggcctaccagacttgaagaaagtggtggtgattccttatgtgtcctccagagagaacatagacctttcaaagattccaaacagtgtgtttctggatgactttcttgccaccggcaccagtgagcaggccccgcagctggagttcgagcagctgcccttcagccacccactgttcatcatgttctcatcgggcaccacgggcgcacccaagtgcatggtgcattccgctgggggcaccctcatccagcatctgaaggagcacctgctgcacggcaacatgaccagcagtgacatcctcctgtgctacaccacggtcggctggatgatgtggaactggatggtgtcccttctggccacaggagcggccatggtcttgtacgatggctcccccctggtgcccacgcccaatgtgctctgggacctggttgacaggataggcatcactgtcctggtaactggggccaagtggctgtcagtgctggaagagaaggccatgaagccggtggaaacccacagtctccagatgctccacacgatcctgtccactggctccccactgaaagcccagagctacgagtatgtctacaggtgcatcaagagcagcatcctcctgggctccatctcaggaggcaccgacatcatctcctgcttcatgggccacaatttttctcttcctgtgtataaaggggagattcaggcccggaacctgggcatggccgtggaagcgtggaacgaggaaggaaaggcggtctggggagagagcggcgagctggtgtgtactaagccgatcccttgccagcccacacacttctggaacgatgagaacggcaacaagtacaggaaggcgtatttctccaaattcccaggtatctgggctcatggcgactactgcagaatcaaccccaagaccgggggcatcgtcatgcttggccggagtgacggcaccctcaaccccaacggggtgcggttcggcagctcggaaatctataacattgtggaatccttcgaggaggtggaggacagcctgtgtgtcccccagtataacaagtacagggaggagagggtgatcctcttcctgaagatggcctccgggcacgccttccagcctgacttggttaagaggatccgtgacgccatccgcatgggcttgtctgcgcgacacgtgcccagcctcatcctggaaaccaagggcatcccgtatacgctcaacggcaagaaagtggaagttgccgtcaaacagatcatcgctggaaaagccgtggagcaaggaggtgctttctcgaaccccgagaccctggatctgtaccgggacatccctgagctgcagggcttctgagtcagactggctggcgtgtcactcagccgcacccgtgtgcactgtaacttttgtgtgctcaagaaattatacagaaacctacagctgttgtaaaaggatgctcgcaccaagtgttctgtaggcttggggagggatcgtttctctgttttgttaaatctggtgggtacctggatcttccacacgagtgggattctggccttcagagaccaggagggagtgtctgggccgcaggtgtggcactgtggtgagagtgtgtgtctttgcacacacagtgcagcgggaacggtggggctggctggtgctgaagacagacacactcctgagccaaggtcttgtcttcaacctccccgtcccgttgtcccattttgctctgtgaaggtgcaaatccctttcttcccttcccatctcaggctctcctgttttccctcagggtccagtatgcctttgagctttagctgttagaaaggaacccccgtgacttgacacagctttcacagctggctgctaggaccggcgggctgggtgttcacgtgtgtctgtgtcatggatgcaatgcaggccctggaggactgtgcgtcacccgtcaaccagagcgtgcctccgggccagcttccctccaaggaatgagtggatttcatacaggatctctttattgcacagactgaatggctttacatgtttctaatgtgaattaggcatgtgaagcagtgggtgtccacccgtgtccctcatgggtgagccctccagctgtgagcccaggcagtgtggtcaccgagtgaggaccctcctcaccaggaaccgcatccctgtgctgcctccacctgagagttgctagggggttcttgtcgagatcatgtcatcagcacccctaagtcaagtcacgggtttccatagccaggcagttggtatgtacaattcagttcagcgtatgaacttgtatctctaatctgatgtccatttttatattttttgaaactgagcacaatgaaatcctttcttgaatcattttccttttggattataaaaatatgggggaaagtgctatgatgaattttatgcaataaatgtatacatgtgtgcacatgcacccatgctgtg

SEQ ID NO: 71641 - DNA, 2918 bp, Homo sapiens
gggctaggtacgaggccgggtggttaatacggccgagggttgtggacacatcgaaaggaatcgcagatgtccccgagtggttcaaaggcagtcggctcaactatgcagaaaacctcctgcggcacaaagagaatgacagagttgccctttacattgcaagggaaggcaaagaggaaattgtgaaggtgacttttgaagagctgaggcaagaagtggctttgtttgcagcagcaatgaggaaaatgggtgtgaagaaaggagatcgggttgttggttatttacccaacagtgagcacgctgtcgaggcgatgctggctgcggcaagcattggtgccatctggagctccacgtccccggacttcggtgtgaatggtgtgctggaccggttttctcaaattcagccaaagctcatcttctctgtggaggctgttgtctataatggcaaagagcacaaccacatggaaaagctgcagcaggtggttaaaggcctaccagacttgaagaaagtggtggtgattccttatgtgtcctccagagagaacatagacctttcaaagattccaaacagtgtgtttctggatgactttcttgccaccggcaccagtgagcaggccccgcagctggagttcgagcagctgcccttcagccacccactgttcatcatgttctcatcgggcaccacgggcgcacccaagtgcatggtgcattccgctgggggcaccctcatccagcatctgaaggagcacctgctgcacggcaacatgaccagcagtgacatcctcctgtgctacaccacggtcggctggatgatgtggaactggatggtgtcccttctggccacaggagcggccatggtcttgtacgatggctcccccctggtgcccacgcccaatgtgctctgggacctggttgacaggataggcatcactgtcctggtaactggggccaagtggctgtcagtgctggaagagaaggccatgaagccggtggaaacccacagtctccagatgctccacacgatcctgtccactggctccccactgaaagcccagagctacgagtatgtctacaggtgcatcaagagcagcatcctcctgggctccatctcaggaggcaccgacatcatctcctgcttcatgggccacaatttttctcttcctgtgtataaaggggagattcaggcccggaacctgggcatggccgtggaagcgtggaacgaggaaggaaaggcggtctggggagagagcggcgagctggtgtgtactaagccgatcccttgccagcccacacacttctggaacgatgagaacggcaacaagtacaggaaggcgtatttctccaaattcccaggtatctgggctcatggcgactactgcagaatcaaccccaagaccgggggcatcgtcatgcttggccggagtgacggcaccctcaaccccaacggggtgcggttcggcagctcggaaatctataacattgtggaatccttcgaggaggtggaggacagcctgtgtgtcccccagtataacaagtacagggaggagagggtgatcctcttcctgaagatggcctccgggcacgccttccagcctgacttggttaagaggatccgtgacgccatccgcatgggcttgtctgcgcgacacgtgcccagcctcatcctggaaaccaagggcatcccgtatacgctcaacggcaagaaagtggaagttgccgtcaaacagatcatcgctggaaaagccgtggagcaaggaggtgctttctcgaaccccgagaccctggatctgtaccgggacatccctgagctgcagggcttctgagtcagactggctggcgtgtcactcagccgcacccgtgtgcactgtaacttttgtgtgctcaagaaattatacagaaacctacagctgttgtaaaaggatgctcgcaccaagtgttctgtaggcttggggagggatcgtttctctgttttgttaaatctggtgggtacctggatcttccacacgagtgggattctggccttcagagaccaggagggagtgtctgggccgcaggtgtggcactgtggtgagagtgtgtgtctttgcacacacagtgcagcgggaacggtggggctggctggtgctgaagacagacacactcctgagccaaggtcttgtcttcaacctccccgtcccgttgtcccattttgctctgtgaaggtgcaaatccctttcttcccttcccatctcaggctctcctgttttccctcagggtccagtatgcctttgagctttagctgttagaaaggaacccccgtgacttgacacagctttcacagctggctgctaggaccggcgggctgggtgttcacgtgtgtctgtgtcatggatgcaatgcaggccctggaggactgtgcgtcacccgtcaaccagagcgtgcctccgggccagcttccctccaaggaatgagtggatttcatacaggatctctttattgcacagactgaatggctttacatgtttctaatgtgaattaggcatgtgaagcagtgggtgtccacccgtgtccctcatgggtgagccctccagctgtgagcccaggcagtgtggtcaccgagtgaggaccctcctcaccaggaaccgcatccctgtgctgcctccacctgagagttgctagggggttcttgtcgagatcatgtcatcagcacccctaagtcaagtcacgggtttccatagccaggcagttggtatgtacaattcagttcagcgtatgaacttgtatctctaatctgatgtccatttttatattttttgaaactgagcacaatgaaatcctttcttgaatcattttccttttggattataaaaatatgggggaaagtgctatgatgaattttatgcaataaatgtatacatgtgtgcacatgcacccatgctgtg

SEQ ID NO: 71642 - DNA, 3000 bp, Homo sapiens
acctgcagattggaggttacatttcaacacgagatgagggtggggacaaacatccacactcttatcagcaccttcctctcaggctggctgggaggattaaataagctgctgctctgcaaagcgtgcacagtcagctctcagtgatcctgcctgtcattgtgcggccgcggtgggctctgtcgcctgaagcacctgagtcagggtgggcagattcttcacaggcaggcccgggtgcctgtcccatggactgtgggaccctgccgaccttaataaattataaccaggtgccagagcgctggctttctttcatgcaacctcggattttgtgccccaggtgtatggatggaggccatgatgcatggaggctaggaggaaaaccagacagggtttaccagccccctggttggcctggctattttttctgaataatattcatcagcagttgatataaaatgagggcatccagcagaatcatgttagccacttcatttagcccgacaccccaggggctggactcccactgcagtccatcctttgattgtggatgccacagataaagcagaaacgggtacgtgcccatctgtggagaattgacggggccgggggagccaccctgtgggcttttcattcttagaagagctttaacaaagtgtgtttctggatgactttcttgccaccggcaccagtgagcaggccccgcagctggagttcgagcagctgcccttcagccacccactgttcatcatgttctcatcgggcaccacgggcgcacccaagtgcatggtgcattccgctgggggcaccctcatccagcatctgaaggagcacctgctgcacggcaacatgaccagcagtgacatcctcctgtgctacaccacggtcggctggatgatgtggaactggatggtgtcccttctggccacaggagcggccatggtcttgtacgatggctcccccctggtgcccacgcccaatgtgctctgggacctggttgacaggataggcatcactgtcctggtaactggggccaagtggctgtcagtgctggaagagaaggccatgaagccggtggaaacccacagtctccagatgctccacacgatcctgtccactggctccccactgaaagcccagagctacgagtatgtctacaggtgcatcaagagcagcatcctcctgggctccatctcaggaggcaccgacatcatctcctgcttcatgggccacaatttttctcttcctgtgtataaaggggagattcaggcccggaacctgggcatggccgtggaagcgtggaacgaggaaggaaaggcggtctggggagagagcggcgagctggtgtgtactaagccgatcccttgccagcccacacacttctggaacgatgagaacggcaacaagtacaggaaggcgtatttctccaaattcccaggtatctgggctcatggcgactactgcagaatcaaccccaagaccgggggcatcgtcatgcttggccggagtgacggcaccctcaaccccaacggggtgcggttcggcagctcggaaatctataacattgtggaatccttcgaggaggtggaggacagcctgtgtgtcccccagtataacaagtacagggaggagagggtgatcctcttcctgaagatggcctccgggcacgccttccagcctgacttggttaagaggatccgtgacgccatccgcatgggcttgtctgcgcgacacgtgcccagcctcatcctggaaaccaagggcatcccgtatacgctcaacggcaagaaagtggaagttgccgtcaaacagatcatcgctggaaaagccgtggagcaaggaggtgctttctcgaaccccgagaccctggatctgtaccgggacatccctgagctgcagggcttctgagtcagactggctggcgtgtcactcagccgcacccgtgtgcactgtaacttttgtgtgctcaagaaattatacagaaacctacagctgttgtaaaaggatgctcgcaccaagtgttctgtaggcttggggagggatcgtttctctgttttgttaaatctggtgggtacctggatcttccacacgagtgggattctggccttcagagaccaggagggagtgtctgggccgcaggtgtggcactgtggtgagagtgtgtgtctttgcacacacagtgcagcgggaacggtggggctggctggtgctgaagacagacacactcctgagccaaggtcttgtcttcaacctccccgtcccgttgtcccattttgctctgtgaaggtgcaaatccctttcttcccttcccatctcaggctctcctgttttccctcagggtccagtatgcctttgagctttagctgttagaaaggaacccccgtgacttgacacagctttcacagctggctgctaggaccggcgggctgggtgttcacgtgtgtctgtgtcatggatgcaatgcaggccctggaggactgtgcgtcacccgtcaaccagagcgtgcctccgggccagcttccctccaaggaatgagtggatttcatacaggatctctttattgcacagactgaatggctttacatgtttctaatgtgaattaggcatgtgaagcagtgggtgtccacccgtgtccctcatgggtgagccctccagctgtgagcccaggcagtgtggtcaccgagtgaggaccctcctcaccaggaaccgcatccctgtgctgcctccacctgagagttgctagggggttcttgtcgagatcatgtcatcagcacccctaagtcaagtcacgggtttccatagccaggcagttggtatgtacaattcagttcagcgtatgaacttgtatctctaatctgatgtccatttttatattttttgaaactgagcacaatgaaatcctttcttgaatcattttccttttggattataaaaatatgggggaaagtgctatgatgaattttatgcaataaatgtatacatgtgtgcacatgcacccatgctgtg

SEQ ID NO: 71643 - DNA, 3529 bp, Homo sapiens
tgcggggcggggcgtgggccaagcggcccgcaggaggcggcggcggccgttcagtcttgttgttccccgccgccgccgtcgctgacccagcccgccaggcgctcctgaccgtcgcttcctccggtcccaggtccccggccctcgcctcagccccggcccctggtccccagccctcgtcgcagccccggccgcccgccgccgccatgtccaaggaggagcgccccggtcgggaggagatcctggagtgccaggtgatgtgggagcctgacagtaagaagaacacgcagatggaccgcttccgggcggctgtgggcgccgcctgcggcctggcgctggagagttatgatgacttgtaccattggtccgttgagtcatattcagacttctgggcagagttctggaaattcagtggaattgtcttctcacgtgtgtatgatgaggttgtggacacatcgaaaggaatcgcagatgtccccgagtggttcaaaggcagtcggctcaactatgcagaaaacctcctgcggcacaaagagaatgacagagttgccctttacattgcaagggaaggcaaagaggaaattgtgaaggtgacttttgaagagctgaggcaagaagtggctttgtttgcagcagcaatgaggaaaatgggtgtgaagaaaggagatcgggttgttggttatttacccaacagtgagcacgctgtcgaggcgatgctggctgcggcaagcattggtgccatctggagctccacgtccccggacttcggtgtgaatggtgtgctggaccggttttctcaaattcagccaaagctcatcttctctgtggaggctgttgtctataatggcaaagagcacaaccacatggaaaagctgcagcaggtggttaaaggcctaccagacttgaagaaagtggtggtgattccttatgtgtcctccagagagaacatagacctttcaaagattccaaacagtgtgtttctggatgactttcttgccaccggcaccagtgagcaggccccgcagctggagttcgagcagctgcccttcagccacccactgttcatcatgttctcatcgggcaccacgggcgcacccaagtgcatggtgcattccgctgggggcaccctcatccagcatctgaaggagcacctgctgcacggcaacatgaccagcagtgacatcctcctgtgctacaccacggtcggctggatgatgtggaactggatggtgtcccttctggccacaggagcggccatggtcttgtacgatggctcccccctggtgcccacgcccaatgtgctctgggacctggttgacaggataggcatcactgtcctggtaactggggccaagtggctgtcagtgctggaagagaaggccatgaagccggtggaaacccacagtctccagatgctccacacgatcctgtccactggctccccactgaaagcccagagctacgagtatgtctacaggtgcatcaagagcagcatcctcctgggctccatctcaggaggcaccgacatcatctcctgcttcatgggccacaatttttctcttcctgtgtataaaggggagattcaggcccggaacctgggcatggccgtggaagcgtggaacgaggaaggaaaggcggtctggggagagagcggcgagctggtgtgtactaagccgatcccttgccagcccacacacttctggaacgatgagaacggcaacaagtacaggaaggcgtatttctccaaattcccaggtatctgggctcatggcgactactgcagaatcaaccccaagaccgggggcatcgtcatgcttggccggagtgacggcaccctcaaccccaacggggtgcggttcggcagctcggaaatctataacattgtggaatccttcgaggaggtggaggacagcctgtgtgtcccccagtataacaagtacagggaggagagggtgatcctcttcctgaagatggcctccgggcacgccttccagcctgacttggttaagaggatccgtgacgccatccgcatgggcttgtctgcgcgacacgtgcccagcctcatcctggaaaccaagggcatcccgtatacgctcaacggcaagaaagtggaagttgccgtcaaacagatcatcgctggaaaagccgtggagcaaggaggtgctttctcgaaccccgagaccctggatctgtaccgggacatccctgagctgcagggcttctgagtcagactggctggcgtgtcactcagccgcacccgtgtgcactgtaacttttgtgtgctcaagaaattatacagaaacctacagctgttgtaaaaggatgctcgcaccaagtgttctgtaggcttggggagggatcgtttctctgttttgttaaatctggtgggtacctggatcttccacacgagtgggattctggccttcagagaccaggagggagtgtctgggccgcaggtgtggcactgtggtgagagtgtgtgtctttgcacacacagtgcagcgggaacggtggggctggctggtgctgaagacagacacactcctgagccaaggtcttgtcttcaacctccccgtcccgttgtcccattttgctctgtgaaggtgcaaatccctttcttcccttcccatctcaggctctcctgttttccctcagggtccagtatgcctttgagctttagctgttagaaaggaacccccgtgacttgacacagctttcacagctggctgctaggaccggcgggctgggtgttcacgtgtgtctgtgtcatggatgcaatgcaggccctggaggactgtgcgtcacccgtcaaccagagcgtgcctccgggccagcttccctccaaggaatgagtggatttcatacaggatctctttattgcacagactgaatggctttacatgtttctaatgtgaattaggcatgtgaagcagtgggtgtccacccgtgtccctcatgggtgagccctccagctgtgagcccaggcagtgtggtcaccgagtgaggaccctcctcaccaggaaccgcatccctgtgctgcctccacctgagagttgctagggggttcttgtcgagatcatgtcatcagcacccctaagtcaagtcacgggtttccatagccaggcagttggtatgtacaattcagttcagcgtatgaacttgtatctctaatctgatgtccatttttatattttttgaaactgagcacaatgaaatcctttcttgaatcattttccttttggattataaaaatatgggggaaagtgctatgatgaattttatgcaataaatgtatacatgtgtgcacatgcacccatgctgtgaaaaaaaaaacacaacacaaaaaaacaaaagcaaataagaaacaaaaaggcacgagacgaccgaacggcgacgagacagagccacaaggcgggccacacgccaccgcagacggagagcggcgggggggaggggtcagagcggaacagagtgacagcgccggcgtggggccgaggggcagtgcagtacccagcagcgggtcggggaggag

SEQ ID NO: 71644 - DNA, 1776 bp, Homo sapiens
gcttacggctaggtacgaggctgcgtgtgggagattcaggcccggaacctgggcatggccgtggaagcgtggaacgaggaaggaaaggcggtctggggagagagcggcgagctggtgtgtactaagccgatcccttgccagcccacacacttctggaacgatgagaacggcaacaagtacaggaaggcgtatttctccaaattcccaggtatctgggctcatggcgactactgcagaatcaaccccaagaccgggggcatcgtcatgcttggccggagtgacggcaccctcaaccccaacggggtgcggttcggcagctcggaaatctataacattgtggaatccttcgaggaggtggaggacagcctgtgtgtcccccagtataacaagtacagggaggagagggtgatcctcttcctgaagatggcctccgggcacgccttccagcctgacttggttaagaggatccgtgacgccatccgcatgggcttgtctgcgcgacacgtgcccagcctcatcctggaaaccaagggcatcccgtatacgctcaacggcaagaaagtggaagttgccgtcaaacagatcatcgctggaaaagccgtggagcaaggaggtgctttctcgaaccccgagaccctggatctgtaccgggacatccctgagctgcagggcttctgagtcagactggctggcgtgtcactcagccgcacccgtgtgcactgtaacttttgtgtgctcaagaaattatacagaaacctacagctgttgtaaaaggatgctcgcaccaagtgttctgtaggcttggggagggatcgtttctctgttttgttaaatctggtgggtacctggatcttccacacgagtgggattctggccttcagagaccaggagggagtgtctgggccgcaggtgtggcactgtggtgagagtgtgtgtctttgcacacacagtgcagcgggaacggtggggctggctggtgctgaagacagacacactcctgagccaaggtcttgtcttcaacctccccgtcccgttgtcccattttgctctgtgaaggtgcaaatccctttcttcccttcccatctcaggctctcctgttttccctcagggtccagtatgcctttgagctttagctgttagaaaggaacccccgtgacttgacacagctttcacagctggctgctaggaccggcgggctgggtgttcacgtgtgtctgtgtcatggatgcaatgcaggccctggaggactgtgcgtcacccgtcaaccagagcgtgcctccgggccagcttccctccaaggaatgagtggatttcatacaggatctctttattgcacagactgaatggctttacatgtttctaatgtgaattaggcatgtgaagcagtgggtgtccacccgtgtccctcatgggtgagccctccagctgtgagcccaggcagtgtggtcaccgagtgaggaccctcctcaccaggaaccgcatccctgtgctgcctccacctgagagttgctagggggttcttgtcgagatcatgtcatcagcacccctaagtcaagtcacgggtttccatagccaggcagttggtatgtacaattcagttcagcgtatgaacttgtatctctaatctgatgtccatttttatattttttgaaactgagcacaatgaaatcctttcttgaatcattttccttttggattataaaaatatgggggaaagtgctatgatgaattttatgcaataaatgtatacatgtgtgcacatgcacccatgctgtg

SEQ ID NO: 71645 - DNA, 3165 bp, Homo sapiens
tgcggggcggggcgtgggccaagcggcccgcaggaggcggcggcggccgttcagtcttgttgttccccgccgccgccgtcgctgacccagcccgccaggcgctcctgaccgtcgcttcctccggtcccaggtccccggccctcgcctcagccccggcccctggtccccagccctcgtcgcagccccggccgcccgccgccgccatgtccaaggaggagcgccccggtcgggaggagatcctggagtgccaggtgatgtgggagcctgacagtaagaagaacacgcagatggaccgcttccgggcggctgtgggcgccgcctgcggcctggcgctggagagttatgatgacttgtaccattggtccgttgagtcatattcagacttctgggcagagttctggaaattcagtggaattgtcttctcacgtgtgtatgatgaggttgtggacacatcgaaaggaatcgcagatgtccccgagtggttcaaaggcagtcggctcaactatgcagaaaacctcctgcggcacaaagagaatgacagagttgccctttacattgcaagggaaggcaaagaggaaattgtgaaggtgacttttgaagagctgaggcaagaagtggctttgtttgcagcagcaatgaggaaaatgggtgtgaagaaaggagatcgggttgttggttatttacccaacagtgagcacgctgtcgaggcgatgctggctgcggcaagcattggtgccatctggagctccacgtccccggacttcggtgtgaatggtgtgctggaccggttttctcaaattcagccaaagctcatcttctctgtggaggctgttgtctataatggcaaagagcacaaccacatggaaaagctgcagcaggtggttaaaggcctaccagacttgaagaaagtggtggtgattccttatgtgtcctccagagagaacatagacctttcaaagattccaaacagtgtgtttctggatgactttcttgccaccggcaccagtgagcaggccccgcagctggagttcgagcagctgcccttcagccacccactgttcatcatgttctcatcgggcaccacgggcgcacccaagtgcatggtgcattccgctgggggcaccctcatccagcatctgaaggagcacctgctgcacggcaacatgaccagcagtgacatcctcctgtgctacaccacggtcggctggatgatgtggaactggatggtgtcccttctggccacaggagcggccatggtcttgtacgatggctcccccctggtgcccacgcccaatgtgctctgggacctggttgacaggataggcatcactgtcctggtaactggggccaagtggctgtcagtgctggaagagaaggccatgaagccggtggaaacccacagtctccagatgctccacacgatcctgtccactggctccccactgaaagcccagagctacgagtatgtctacaggtgcatcaagagcagcatcctcctgggctccatctcaggaggcaccgacatcatctcctgcttcatgggccacaatttttctcttcctgtgtataaaggggagattcaggcccggaacctgggcatggccgtggaagcgtggaacgaggaaggaaaggcggtctggggagagagcggcgagctggtgtgtactaagccgatcccttgccagcccacacacttctggaacgatgagaacggcaacaagtacaggaaggcgtatttctccaaattcccaggtatctgggctcatggcgactactgcagaatcaaccccaagaccgggggcatcgtcatgcttggccggagtgacggcaccctcaaccccaacggggtgcggttcggcagctcggaaatctataacattgtggaatccttcgaggaggtggaggacagcctgtgtgtcccccagtataacaagtacagggaggagagggtgatcctcttcctgaagatggcctccgggcacgccttccagcctgacttggttaagaggatccgtgacgccatccgcatgggcttgtctgcgcgacacgtgcccagcctcatcctggaaaccaagggcatcccgtatacgctcaacggcaagaaagtggaagttgccgtcaaacagatcatcgctggaaaagccgtggagcaaggaggtgctttctcgaaccccgagaccctggatctgtaccgggacatccctgagctgcagggcttctgagtcagactggctggcgtgtcactcagccgcacccgtgtgcactgtaacttttgtgtgctcaagaaattatacagaaacctacagctgttgtaaaaggatgctcgcaccaagtgttctgtaggcttggggagggatcgtttctctgttttgttaaatctggtgggtacctggatcttccacacgagtgggattctggccttcagagaccaggagggagtgtctgggccgcaggtgtggcactgtggtgagagtgtgtgtctttgcacacacagtgcagcgggaacggtggggctggctggtgctgaagacagacacactcctgagccaaggtcttgtcttcaacctccccgtcccgttgtcccattttgctctgtgaaggtgcaaatccctttcttcccttcccatctcaggctctcctgttttccctcagggtccagtatgcctttgagctttagctgttagaaaggaatgagtggatttcatacaggatctctttattgcacagactgaatggctttacatgtttctaatgtgaattaggcatgtgaagcagtgggtgtccacccgtgtccctcatgggtgagccctccagctgtgagcccaggcagtgtggtcaccgagtgaggaccctcctcaccaggaaccgcatccctgtgctgcctccacctgagagttgctagggggttcttgtcgagatcatgtcatcagcacccctaagtcaagtcacgggtttccatagccaggcagttggtatgtacaattcagttcagcgtatgaacttgtatctctaatctgatgtccatttttatattttttgaaactgagcacaatgaaatcctttcttgaatcattttccttttggattataaaaatatgggggaaagtgctatgatgaattttatgcaataaatgtatacatgtgtgcacatgcacccatgctgtg

SEQ ID NO: 71646 - DNA, 2737 bp, Homo sapiens
tgcggggcggggcgtgggccaagcggcccgcaggaggcggcggcggccgttcagtcttgttgttccccgccgccgccgtcgctgacccagcccgccaggcgctcctgaccgtcgcttcctccggtcccaggtccccggccctcgcctcagccccggcccctggtccccagccctcgtcgcagccccggccgcccgccgccgccatgtccaaggaggagcgccccggtcgggaggagatcctggagtgccaggtgatgtgggagcctgacagtaagaagaacacgcagatggaccgcttccgggcggctgtgggcgccgcctgcggcctggcgctggagagttatgatgacttgtaccattggtccgttgagtcatattcagacttctgggcagagttctggaaattcagtggaattgtcttctcacgtgtgtatgatgaggttgtggacacatcgaaaggaatcgcagatgtccccgagtggttcaaaggcagtcggctcaactatgcagaaaacctcctgcggcacaaagagaatgacagagttgccctttacattgcaagggaaggcaaagaggaaattgtgaaggtgacttttgaagagctgaggcaagaagtggctttgtttgcagcagcaatgaggaaaatgggtgtgaagaaaggagatcgggttgttggttatttacccaacagtgagcacgctgtcgaggcgatgctggctgcggcaagcattggtgccatctggagctccacgtccccggacttcggtgtgaatggtgtgctggaccggttttctcaaattcagccaaagctcatcttctctgtggaggctgttgtctataatggcaaagagcacaaccacatggaaaagctgcagcaggtggttaaaggcctaccagacttgaagaaagtggtggtgattccttatgtgtcctccagagagaacatagacctttcaaagattccaaacagtgtgtttctggatgactttcttgccaccggcaccagtgagcaggccccgcagctggagttcgagcagctgcccttcagccacccactgttcatcatgttctcatcgggcaccacgggcgcacccaagtgcatggtgcattccgctgggggcaccctcatccagcatctgaaggagcacctgctgcacggcaacatgaccagcagtgacatcctcctgtgctacaccacggtcggctggatgatgtggaactggatggtgtcccttctggccacaggagcggccatggtcttgtacgatggctcccccctggtgcccacgcccaatgtgctctgggacctggttgacaggatagggtatctgggctcatggcgactactgcagaatcaaccccaagaccgggggcatcgtcatgcttggccggagtgacggcaccctcaaccccaacggggtgcggttcggcagctcggaaatctataacattgtggaatccttcgaggaggtggaggacagcctgtgtgtcccccagtataacaagtacagggaggagagggtgatcctcttcctgaagatggcctccgggcacgccttccagcctgacttggttaagaggatccgtgacgccatccgcatgggcttgtctgcgcgacacgtgcccagcctcatcctggaaaccaagggcatcccgtatacgctcaacggcaagaaagtggaagttgccgtcaaacagatcatcgctggaaaagccgtggagcaaggaggtgctttctcgaaccccgagaccctggatctgtaccgggacatccctgagctgcagggcttctgagtcagactggctggcgtgtcactcagccgcacccgtgtgcactgtaacttttgtgtgctcaagaaattatacagaaacctacagctgttgtaaaaggatgctcgcaccaagtgttctgtaggcttggggagggatcgtttctctgttttgttaaatctggtgggtacctggatcttccacacgagtgggattctggccttcagagaccaggagggagtgtctgggccgcaggtgtggcactgtggtgagagtgtgtgtctttgcacacacagtgcagcgggaacggtggggctggctggtgctgaagacagacacactcctgagccaaggtcttgtcttcaacctccccgtcccgttgtcccattttgctctgtgaaggtgcaaatccctttcttcccttcccatctcaggctctcctgttttccctcagggtccagtatgcctttgagctttagctgttagaaaggaatgagtggatttcatacaggatctctttattgcacagactgaatggctttacatgtttctaatgtgaattaggcatgtgaagcagtgggtgtccacccgtgtccctcatgggtgagccctccagctgtgagcccaggcagtgtggtcaccgagtgaggaccctcctcaccaggaaccgcatccctgtgctgcctccacctgagagttgctagggggttcttgtcgagatcatgtcatcagcacccctaagtcaagtcacgggtttccatagccaggcagttggtatgtacaattcagttcagcgtatgaacttgtatctctaatctgatgtccatttttatattttttgaaactgagcacaatgaaatcctttcttgaatcattttccttttggattataaaaatatgggggaaagtgctatgatgaattttatgcaataaatgtatacatgtgtgcacatgcacccatgctgtg

SEQ ID NO: 71647 - DNA, 1613 bp, Homo sapiens
cggctaggtagcgaggctgggtgggcgtatttctccaaatcccaggtatctgggctcatggcgactactgcagaatcaaccccaagaccgggggcatcgtcatgcttggccggagtgacggcaccctcaaccccaacggggtgcggttcggcagctcggaaatctataacattgtggaatccttcgaggaggtggaggacagcctgtgtgtcccccagtataacaagtacagggaggagagggtgatcctcttcctgaagatggcctccgggcacgccttccagcctgacttggttaagaggatccgtgacgccatccgcatgggcttgtctgcgcgacacgtgcccagcctcatcctggaaaccaagggcatcccgtatacgctcaacggcaagaaagtggaagttgccgtcaaacagatcatcgctggaaaagccgtggagcaaggaggtgctttctcgaaccccgagaccctggatctgtaccgggacatccctgagctgcagggcttctgagtcagactggctggcgtgtcactcagccgcacccgtgtgcactgtaacttttgtgtgctcaagaaattatacagaaacctacagctgttgtaaaaggatgctcgcaccaagtgttctgtaggcttggggagggatcgtttctctgttttgttaaatctggtgggtacctggatcttccacacgagtgggattctggccttcagagaccaggagggagtgtctgggccgcaggtgtggcactgtggtgagagtgtgtgtctttgcacacacagtgcagcgggaacggtggggctggctggtgctgaagacagacacactcctgagccaaggtcttgtcttcaacctccccgtcccgttgtcccattttgctctgtgaaggtgcaaatccctttcttcccttcccatctcaggctctcctgttttccctcagggtccagtatgcctttgagctttagctgttagaaaggaacccccgtgacttgacacagctttcacagctggctgctaggaccggcgggctgggtgttcacgtgtgtctgtgtcatggatgcaatgcaggccctggaggactgtgcgtcacccgtcaaccagagcgtgcctccgggccagcttccctccaaggaatgagtggatttcatacaggatctctttattgcacagactgaatggctttacatgtttctaatgtgaattaggcatgtgaagcagtgggtgtccacccgtgtccctcatgggtgagccctccagctgtgagcccaggcagtgtggtcaccgagtgaggaccctcctcaccaggaaccgcatccctgtgctgcctccacctgagagttgctagggggttcttgtcgagatcatgtcatcagcacccctaagtcaagtcacgggtttccatagccaggcagttggtatgtacaattcagttcagcgtatgaacttgtatctctaatctgatgtccatttttatattttttgaaactgagcacaatgaaatcctttcttgaatcattttccttttggattataaaaatatgggggaaagtgctatgatgaattttatgcaataaatgtatacatgtgtgcacatgcacccatgctgtg

SEQ ID NO: 71648 - DNA, 907 bp, Homo sapiens
agtgcgacggagactctcaccacaagtgtctgggccgcaggtgtggcactgtggtgagagtgtgtgtctttgcacacacagtgcagcgggaacggtggggctggctggtgctgaagacagacacactcctgagccaaggtcttgtcttcaacctccccgtcccgttgtcccattttgctctgtgaaggtgcaaatccctttcttcccttcccatctcaggctctcctgttttccctcagggtccagtatgcctttgagctttagctgttagaaaggaacccccgtgacttgacacagctttcacagctggctgctaggaccggcgggctgggtgttcacgtgtgtctgtgtcatggatgcaatgcaggccctggaggactgtgcgtcacccgtcaaccagagcgtgcctccgggccagcttccctccaaggaatgagtggatttcatacaggatctctttattgcacagactgaatggctttacatgtttctaatgtgaattaggcatgtgaagcagtgggtgtccacccgtgtccctcatgggtgagccctccagctgtgagcccaggcagtgtggtcaccgagtgaggaccctcctcaccaggaaccgcatccctgtgctgcctccacctgagagttgctagggggttcttgtcgagatcatgtcatcagcacccctaagtcaagtcacgggtttccatagccaggcagttggtatgtacaattcagttcagcgtatgaacttgtatctctaatctgatgtccatttttatattttttgaaactgagcacaatgaaatcctttcttgaatcattttccttttggattataaaaatatgggggaaagtgctatgatgaattttatgcaataaatgtatacatgtgtgcacatgcacccatgctgtg

SEQ ID NO: 71649 - DNA, 841 bp, Homo sapiens
tgcggggcggggcgtgggccaagcggcccgcaggaggcggcggcggccgttcagtcttgttgttccccgccgccgccgtcgctgacccagcccgccaggcgctcctgaccgtcgcttcctccggtcccaggtccccggccctcgcctcagccccggcccctggtccccagccctcgtcgcagccccggccgcccgccgccgccatgtccaaggaggagcgccccggtcgggaggagatcctggagtgccaggtgatgtgggagcctgacagtaagaagaacacgcagatggaccgcttccgggcggctgtgggcgccgcctgcggcctggcgctggagagttatgatgacttgtaccattggtccgttgagtcatattcagacttctgggcagagttctggaaattcagtggaattgtcttctcacgtgtgtatgatgaggttgtggacacatcgaaaggaatcgcagatgtccccgagtggttcaaaggcagtcggctcaactatgcagaaaacctcctgcggcacaaagagaatgacagagttgccctttacattgcaagggaaggcaaagaggaaattgtgaaggtgacttttgaagagctgaggcaagaagtggctttgtttgcagcagcaatgaggaaaatgggtatgtacaattcagttcagcgtatgaacttgtatctctaatctgatgtccatttttatattttttgaaactgagcacaatgaaatcctttcttgaatcattttccttttggattataaaaatatgggggaaagtgctatgatgaattttatgcaataaatgtatacatgtgtgcacatgcacccatgctgtg

SEQ ID NO: 71650 - DNA, 459 bp, Homo sapiens
agccttcccatgtgatgggtctgtctaggcagtgcctgccaggtatgtatcacaggcaaagcttccattttctgcgatcctgagtcttgaatttcagcatgaccacaggaggtcatttacttagcggatcctctggcaggaaggctcggctaaaacgtcaatcaccagatgtggggggttcattctaatttccatatcacctctcccactgctccctgaagagaagccccacctgtctgggatgttgcagtgtttgtctgggagagtagatatttgtcctcttggcaccttctcctttgttgctcactaatttaacacaatttgtcttgggcttctaaattttgagtctccctttgccattgcttgcaggaggcaccgacatcatctcctgcttcatgggccacaatttttctcttcctgtgtataaaggggagattcaggcccggaacctgggcatgg

SEQ ID NO: 71651 - DNA, 679 bp, Homo sapiens
agcacccctctaccacatcccctgcctatctccccctcctggaagggtagacaagggctaaggaccttctgtccctcctgacttccctgctgcctcccatccaacactttcaatgggggccaagggagagaaggagagtctggggctggttttagccagagagaagcggatggaggcggaacgctggcagaggacgttggtgggctgcgtcccagcttcgtcagccccacctggcctgaccccaccacacaggggtcggcttccatgcatcttggttctggggacccattctcagggaggtgggtcttggaaggagagaagatggcagcccgcattacccagagggaccccagcccctctctctgcatgacagctgggtgggaagattctgggcttgcatttggacaggtgttttaatcagatttcaacatcccatagacacgttaccttgggtaagtcaccgggactgccacagatgcaaaatagtgggaagaatccttgcttcgagtccctattctgctacttcctagttgtgtggcctcagacaatgcacctgccttctctgagccttagttcccatatctctaaaatggagatgatgatactgcacttattctcacaggatgtttgagaatattaagtgagttgatatatattaaagcgtttcaaacagtatctg

SEQ ID NO: 71652 - DNA, 697 bp, Homo sapiens
ggcagggaaatgccgtgggaggcagcagcacagattcttctgtcttttatccacagcaaaaatacccagcagtgacaacatccagtgctgatgggcaggcaggaggaccaggtcattgttttaacacaggtggaagaagcatgacttgcaaatgttctgcagttaattgggcactatcactttgaaaccaaacctggttagaatgaaaagcaccagcatggaagtgtacaagtttattctagtgttgctgggttattgtggagaagatctggaagcaacataaatgtgcctcacttgggagaatttatggtgtggttatctgggcatctagaaccaggaggataaactgttggcaagtgagagtcactgggggaacggtctatagtagtatcctaattgtgtatctttagtttattgtgagcatgtatgatgtctgttaatattttcctccagtagtagagaaaacgtgctaaggaaaaaaaaaaatgaagatggagagagtagaaacagcaagtgagaaggctttctgaaacatgtaaatggagtgggaaggactcaatgggctctcccaccccaccaaaaatatccttcttttaccttatggtttttataatgatcaaagtgagatttgcctgtactcccaccatgagatggcccagcatattgatggaaatccttccagacaaaatggctctgg

SEQ ID NO: 71653 - DNA, 706 bp, Homo sapiens
ctactactactactaaattcgcggccgcgtcgacgcaagttgtaagatcaatacaaaaatcaatattatttctatatactgtcaatgaaacactggaaattgaaaatcttaaaacataatacagccaaatgtggtggctcatggctataatcctgtactttgggaggctgctgttggaggattgtttgaggctgggagttcaagctcagcctgggaaacatagtgagacccttgtctctaccaaaaagaaaaagaaaaagaaaaaaattataattctgtctctcaacaaaatcataattttttttttaatttggccaggtttggtggcgggcatctgtagtcccagctcctgagctgaggctgaggtaggaggatcgcttgagcccaggagtttgaggctgcagtgagctatgataatgccactgcactcttgcctgggggacaagactgagaccttctctctctctcaaaaaaacacacacaaaaaaacatatatatatatatatagccacttacaatatcatttaaaaatgaaatacttaggaatgaatttgaaaagcagttgacctgttctctgaaaattacaaagcattactgagagattaccagatagagatttaccatctcaatattgagctgagatataccaaactcaatattgttaatatgatgattcttccaaaataaactattcaatgcaatacca

SEQ ID NO: 71654 - DNA, 832 bp, Homo sapiens
cttccttttgagaaatgcaacaagctctccagtggtcatctcctgatctgttggccttactggccctcaaatttcctattcatgcattacatatttatttatttactttgagacagagtgagactctgccaaaaaaaaaaaaaagtaatttagcaatgttgcaagttgtaagatcaatacaaaaatcaatattatttctatatactgtcaatgaaacactggaaattgaaaatcttaaaacataatacagccaaatgtggtggctcatggctataatcctgtactttgggaggctgctgttggaggattgtttgaggctgggagttcaagctcagcctgggaaacatagtgagacccttgtctctaccaaaaagaaaaagaaaaagaaaaaaattataattctgtctctcaacaaaatcataattttttttttaatttggccaggtttggtggcgggcatctgtagtcccagctcctgagctgaggctgaggtaggaggatcgcttgagcccaggagtttgaggctgcagtgagctatgataatgccactgcactcttgcctgggggacaagactgagaccttctctctctctcaaaaaaacacacacaaaaaaacatatatatatatatatagccacttacaatatcatttaaaaatgaaatacttaggaatgaatttgaaaagcagttgacctgttctctgaaaattacaaagcattactgagagattaccagatagagatttaccatctcaatattgagctgagatataccaaactcaatattgttaatatgatgattcttccaaaataaactattcaatgcaatacca

SEQ ID NO: 71655 - DNA, 449 bp, Homo sapiens
gggtcttgccatgaaggacattcaagcagttctgaggagaggcccaagtgaagaggaaccagttgccagcaccaccctgtcagctatgttaggcccctgcctatataaacaatttgattaaaaacatatatttaaaaattcatcagtacatgtgagatatgatgatttatcattgaagatttaggatgatgggcagagaaaggcaatctgttttgtctattgtccaatcagtgcacgtgaagatttgttacagtatccagaaaagactaaaaaagaccaagcctgttaaacaactccatcaaagaaaaacaaggaagccatccagctttgttctggactcagcagctaagatggcatgagcttcatcgtaaagcatagttctatgtcatgtctactggatgaatccaatgtggctggtcccttaataaaataagttgtaacataaaaaa

SEQ ID NO: 71656 - DNA, 450 bp, Homo sapiens
tttgggagggaagggaagcagaatttggttggacactaagagagtgagattcaccagggacagctgggtggtgatggaggcctctcaggagagagatcccagctggagaggtgagccagggctgtccacagtgagactactgttatctctgtgccctaattgtattaacatgtaatatggagagggttggtgtcctagctttttttgtttgtgtacatgttctgccttaactgttggttttgtgttttcttttacaaaagttttgtcacctgtgcttttgacttttttgtgtgtgcagggctgttctgcctcatatgttttgtagtcaaacttgtactttatcattttgcccttacaaattatttagattttattcctcgagaagactaagcatgatacagggaataaataaatgagtactcagtagagattcaatatcatgctaacaac

SEQ ID NO: 71657 - DNA, 441 bp, Homo sapiens
aaggacttagacacttgtcagagctagtaaaataacatttcttattcattacaggcttaaagaactttctttctttctaaaccaacagcaggagactctctggccttggggtgggacccagtaggctctgaaaagccaggtcatttgtgtaactctgtggatctgagtgagcctaagaactgactcattcctggggacctctctgcgctgggattgaccaaaagtaaattatctccaagtctctttggaccaaaatgaaccccaaatttaattcagcactttgggaggccaaggtgggtggatcacttgagcccaggagttcaagaccagcctgggcaacatagtaagaccccatctctacaaaaaataaaaaaattagctgggcatggtggcatgcacctgtggacccagctactcaggaggctgagacagggggattgc

SEQ ID NO: 71658 - DNA, 620 bp, Homo sapiens
ctttcaggccggggcggaggttttgcttccgtggcttcctagcccaaggggtgaggctgttagctgcagtgagcccgttttctcttcactcggcctgtcaaagcggcgcaggggccgcgattagcttcctgccccgcgacagctgcacttctggcttgccggggcgaaccgaggggctcggagaccttcagccacgcgaggcccgccagtgagcagtcagaaatcacctcggctttggcccacgcctgctccccggtgacagtcgtccgccctatccgcgtctagctggcgacaaccgcaggggttcacttttggccgtcaggtgccacccggagcagaaattaggggaaccttgtgggattggatcacggtgaagggtcggggcaggaattggaaggccagcctttatagtgcagaaagggagaaaaagcagcataaacgaaaaaaaaaattcttgtggatagcaagtatttacttagaaaaccatcaacactttggtcaaaaggagttacccctcccttacaaacacacacccacacattcatcctagacgaaaaagttaaatgtttctcagccagggcagaatttatggatgtttacccacaacaggtcagcagatt

SEQ ID NO: 71659 - DNA, 465 bp, Homo sapiens
ctagaagttttatggtttgggattttatgtttaggtctgtgatccatctcaaattaatttttgtgaacagaatgaggtttggtttttttccagcatggatatacagttgttccagcaacatttacttaaaaagacttttctttacccattagattgacttggtagcttggttaaaaattgatcacgtgtgtgtgtatttctacattttctgttctgttccattaatctatttgtgtatccttacatcagtaccacactttggattattgaaactttctagtaagtctttaaattagtaaatccttcctttttgttatttttcaagatcgctttggttattgtcgattctttggattgtcataaaagttttacaattagctcatcttgtttttcaaacgtagatgtgctgggttagctgtgttcatgccactgcattccagcttgggtgacagcaagaccctgtca

SEQ ID NO: 71660 - DNA, 3102 bp, Homo sapiens
  misc_feature (1269)..(1269): n is a, c, g, or t
cactgtatgctgtgtggacatgcatttcatgtggctgtgtggtaagaattacagcttacatatggcttggacccacatccgaggaatctgatgttcacttataccagaacattatcttgctatttatgaaattatttaaacgttcaaaagattgtttttaacatggtttaatttcccaaaaactacagttttttttcttagcatgctattcaggtaaacagtcttataataaagcatgtcccattgtcaagaaacataaagtggtgtgaataccactgaaaatatatatatagtatcttctgtaaataatagtacctgtgtgaataaggaataggcttgcctcccagccaggcaatttcctgagggcacactaatgatatcccctgagttgctaagttgatgctgagacattttgctgggaattagtcatggcatgatctctttcagactccctgaataccatttagtcccgtaacagtgctcacaactcatgtgctaatgaatcacaaaggctttaactagctcccaggttgtagccttcgcaggatctagtttatttgccacatctctttatgaacatatagcgattcgcagatctctctattcacggagaggaaggtgttttgcttctgtagatctcaaggtactattttgtggctctcagcaggaagtagaattgttcctaaatgtgtgctgaatgaggacatgatgtccctcctggtgccaggacacatcctgcatggcattctgtgaagggcatacctgctgaggataatgccaggagcagcacatttagggtaattttgctaaaacttccagatgacatataaattccctctttttccccctgaaacttaccatttcagaggtaatggctttttctgtaatttgcctgagaagaaaaaagggataatttagaaataacactccaagcctatatattactagggctgcatcctctggaatttaatagaaaaattgaatatatagccctatgtaactacagacatcattacaactgttaagttctgttcaccatgcaagttctcggtggtgtatgtactctcaccttttggaaacaaaaccttgcattgaaggttttacacatggcttcagaatgttactctgaccatgtttgcctctactccagattatcatggcacctaacacagatgacatatggcagaatggaagtgatttctcctaatgaaaatgaagtgctcttttgagtatttcttgttttattgagattcctatctgcccttgtanttttataactgaatgtaaataggaattgcttaaatactggtttacactaatcccatagttaaaaatcttggctatggtacaggaaggatatctatatagaggatagttccagaaacaagccctggtgaaataggaaatataaaaacttctttatggaacaggaaaacccaagagactttctcgtcagattcctttccagtgcaaagtataacagagataggattatgagatgaaatcacagtagtgtgtttcctttaattttttctgtcttctttttttttttttttttttgagacggagtctcgctctgttgcccaggctggagtgcggtagcacagtcttggctcactgcaacctccacctcctgggttcaagcgattctcctgcctctgcctcctaagtagctgggattacaggcgtgcaccgccaagcccggctaatttttgtatttttagtagagacggggtttcaccatgttatgcaggctggtctcaaactcctgacctcagaatattcacctgcctcggcctcccaaagtgctgggattacagatgtgaatggccacgcctggcctgtttcctttaagttagcacttcacgtgctcttacagcgttaattgccattattggtttgcctgattttcctgcatctcctcatatgtaagtctgcagcccaaggagagaatagtagctgtatgtgcccacaaggggtgtccaagcttcttgattcttgttaatatcgactccccaacattgaaaaaggagtgaagaagggaatatcattttagggtactgctttaaaggaatgataaagtaaacaacgtagcagggaaaataccacttgcacaaatgtatttctttgtcaaagtgtgtacacgctttctgtttgtcctgatgtcctgctgtgaagcagggaccacattgccatttattcattgttccaggcaatgcatttgtccaaacccctctggctctctgatatctctcatttcttgatgttcctattctctgacctcaacaaggaggacactgtctgttgtgtctctttgagactagaactccatgtgtttaaccttcagatccattctctacatgaaccctattctttccaccctggtaagaaggtctggaagacaggtcctaacgaggggtcagagaaggcacagagaaatgaaccagccatgcaggggcagcactgaggaggaaaccccccactctaactgggaggagagtggaaacactcttagtatctcagagtagttaccaatctaagagcatccttcgagtttaagtcaaaactctaggcttaataccaaaaataatacatcatttggaaaaatagcttggagaaaaaaaatcaataaagagtcacataaaatcttaagaaaatggttctattctgtgatatattactaagaaatacagttcttaaacgtgtataactattgtcagacaatttataggtgtttcatctagtcctgggatgaaatacgatgactcatgcaaattcagggagcacactggctgactttaaattggaacattgtaaagtgaaagctgtgaaaggttgtgtgtcctatcaatgagatttattttctaaccaagagctgttcggatgattcagtataaatacgaaaatcacatccaaaaacggtataacccagcttccttaaggcaattttcttctctgaaacaagaatatactcatatgttctttactataatgtatatgatttttatcttgtactttaaaagatgataattatgcattgtatatacgattgtgtgccttgcaataaaatcaaaactgtacctgctgaaaatcacaacagtc

SEQ ID NO: 71661 - DNA, 420 bp, Homo sapiens
gcaacatgtcagatctttcagtgttccaggcaacaacctaaacgtgtatcagtgtctggtaacatgcaagccccagccagggtttgagcctgcagggggaacatgtagctgattaggtcagagtagtcaaggcacttcctcagtcaggacaaaggaaacactggggggatgaaatgggggacccaacactgagtcaggcaggggacacatgccctgtttagagcccacaggccagaccctgccaggccagagcaggggagagccctggccaaggcactccacatgggggtctgtgaccccacgggcaagcctgctacccgggcacgtttgtaccttggagggtcctctcagtcttgccgatgctgtcaacaccctgagcccagggaaatccatcccattaaaataaaggtctggcccaag

SEQ ID NO: 71662 - DNA, 718 bp, Homo sapiens
agctaattggaggcaggggtaacacacatatagacgtgcctggctcatggtaccaagttttagtggatttctttccagaaggcaagcaaaactcaaagtcagaaagggagcattcgaattcatatagatcctcataatcagtcaatttgcaataagaccatagtctgtggctagaggtgcaagaaagagaatctaggcctctggttgaaaggatctgcaggagccaggatagatgtcagggacgcagccaaggtgactgaagcttagggtgggcctgtattctgatgggaaatgaaagcaattagcaaagaaactgggggaaaactctcaaacattaacctgtgccagcatagagggagtaagggaaagactgtgacagagagacacacaagcctaggctcactgctgggaatttaagaaccctgacttgggaggagcaagactagcctcagacctaagcagccaaggctatgatgtgcagcctaccatggtcaagacaggtatgggctgcaggtgggaggccttggagactccagatcttacaggactggagaagagagttaactgacaactttcagaaaacccggaaatacctcccttctttaggggccaccagcatctccagaagatgtccaaaggacagcaattaaaacatgcacaaattcttatattagataacaaaaaagaatcacaggacaaaagaaaataatatagttta

SEQ ID NO: 71663 - DNA, 1403 bp, Homo sapiens
aagtgaagctctttccttggttacagataagacttggtttacactattggccagtatctgctaaacatatgaagacttaactattcagtgttgcctaggcattcgcctgcacaacattttgaggttagaacatagaatattttcagaaatactgttgtagtttgtgagtgttgttcattagttacacattagctatagagtggatgcatgaagccccatgacaccagtaaacttctcttaccagtaggtaaaccaaacaccattctgtcattagcagccctcttaaatgttgcctctccgtatcctgttgcatttttgtgtgcattgtgtttctactgatctctcttaggtttttacggaatcaaaggaaactaatttttccttaatagcaagaaagatgaagaggtaaagggcattgaagcagaaatgtatagtttggggtacgattagaaaactcgtaaggaaacagaagtcctaatttcaaactgactgctcttcgttaagtgctcttaaggagagtctagtaacagtaacactttctggccatttctagtttagattctcttcgttactgaaacttttgagaaatattacctgtggattaattttgcacaatgttctattctcataatgacttacaaattaaactaggtttttattgaactacctcacactaattttctatgctttcccaagtaagctgttgccctgttagatctttactgagtgaattataaatgtgtgttaaatactttctagccaatgttgacacaataccagtaagtatgtaaagtatataccttacatcagtaagagacacgtgtaaaatctttgactgtatgtcttgcaaaattgtgcccgttgacattattactgtttttgtaagtagaaacctgctcgtgatatcggtccatttacattttacaaaaggagtaaatcttagtaaaaattttacgaagaaataaattacttttgtaggcccaatatttggtatatttttgagaagctgttaatcttttagctgaataatgaagttagactgaattacgtgtctccctggactgtgacatctattttctcattacagtttatcctggtcagcagggtgtcacacctggaaacctgagtatgatagctgacatttgcttttctccctctgcgatgtcattcctcctccattcctctccttccctgtgttccgttccctctcctttcctctagacaaaacaaaatggggcactttttagggaatgctgagatcattattgtggtttttcatcattcatgccctagtcattaaacatgcaccactggaatgtaaacaatgttatctagtatgtcaattggttataatattttaaataaaaaagaaaaaagtggtatgaaaattatgaaaaaaaaag

SEQ ID NO: 71664 - DNA, 554 bp, Homo sapiens
tagttagtgtacttaaaggtttgtcaattttgttaatctgtttaaaatacatacttttatcttgattttctttattgttgtcattttccatttcctttgtttgtgctatgatttctaatttcctccctatttctttttttctacttgctttgagtttactttttgagatggaagcttaagttatttggttgaaacctttattttttctaatatagatttttaaagctataaattgccctccctgtactactttagctgtaccacataaattttgatatgctgtgttcttttttattcaattaaaactatcttaatttcccatttgatctgttgtttgatcatggattgtttagaagtatgttgtctaatttccgaatgtggagatgtctcaaatttgtttctgctgttgatttctaatttaattcctttgtggctgtaaaacacactttgtatgagttcagttattttaatttattaggatttattttatggattagcatatgatgtatcttgaacaatttttcatatgtgcttgagaagaacatgtattctga

SEQ ID NO: 71665 - DNA, 463 bp, Homo sapiens
ctgtacttaaccacatagtctatttcaaccatttactcctccacttagctcagtattcattatctacaaatgcctattatctagaaaagtggttctcaaacccataccgcccacagggaacatctggcaatttctggaaatatttttgcttgtcacaactcagggtaggggtgttactggtatctagtgggtagaggtcagggataaaatgcattcacaggacagcctctaacaaaaaattttctggacaaaatgtctatagtgccaaggttgagacaatctgttctaaaataatacttagctcatgttaagccttaaaagttgtttatcaaaatagaaaaatgaggccaggtacagtggctcactcttgtaatcccagtactttgggaggccgaagcagaaggattgcttgaggccagaagtttgagaccagcctgggaaacatagcgagatcccttctctc

SEQ ID NO: 71666 - DNA, 374 bp, Homo sapiens
ctgtacttaaccacatagtctatttcaaccatttactcctccacttagctcagtattcattatctacaaatgcctattatctagaaaagtggttctcaaacccataccgcccacagggaacatctggcaatttctggaaatatttttgcttgtcacaactcagggtaggggtgttactggtatctagtgggtagaggtcagggataaaatgcattcacaggacagcctctaacaaaaaattttctggacaaaatgtctatagtgccaaggttgagacaatctgttctaaaataatacttagctcatgttaagccttaaaagtgtttatcagccaggcatggtggctcacgcctgtaatcccagcactgtgggag

SEQ ID NO: 71667 - DNA, 441 bp, Homo sapiens
gtttgatctacatctgcaagagcctagccattcagtattaaaaagtgatggccctggttgacggtaccacacctgaagacctatgccctttccttcacactccctacttctgcatttcttccctcctgaacgtctatcaagtggaccatatgaaattgccagtattcaactgttttttatcttaaaaggtgacaattctatatcattcaacctaaattaatgtctcaagaacataacctttgtttctattattgtgaccttacttttaaccatcctagagctctttaacctgttcacactggatttcaaggatcttaagttgttctactacataatcactatcacacttcagaaacattttagtttacattaaatacacttaaccccctcatatttcatctcttcctttctcaaaaatagtaataaataacctcaagccat

SEQ ID NO: 71668 - DNA, 470 bp, Homo sapiens
gttttattagttttgcagacagtagacaggaacaaaaaggggcatagtcattcttgctgtgagttaaccctacacttctccaagcagtagaatgtaaactcaactaggcttttgagaactttccctcagtgacttaattaattccatgcccatttctggactttggaatatagcatgcatctatgtagcttgttttttactttatcaaatttaaaatgctcattatcgaacatttatatttttatattaaacttttgtaagtataacctgcttggtttcaaatatttcacatgcaacatgacattggttggaataatgttatgttgtatgtaaaagtgtaagttgtatgtaaaagattaatatcacaatcctttgaaatactttgcaccttgctattgaataaagttgatgacttttaattctgttgacataatctagaacccatagggaaactctatgataatgtttta

SEQ ID NO: 71669 - DNA, 404 bp, Homo sapiens
ttgcattagcacagggctgccgaaggtgaagcagtccatgtcctcggtagccacaggatagactttgccagccttcaccagggcagcacagctggcctctgcctcgatgggtgcatcaagaagcaggaagattgatggcttggtattatattacatttgagacagtgaagaaattttatacaatcagtggaaaagaaaccttatcagatctgatttccaatggaaggaagaattaaaacaagagaaatgaaagtaaattgtcttattcaggctcaactagggatgcattcccatacaagattttgctttgacacaagataccgcaaagattttcagacatggctcccgaattacaagatattttaaacagacatcccccctttggaacccagataaaagaaact

SEQ ID NO: 71670 - DNA, 503 bp, Homo sapiens
agaattttaggtctgatcgtgctgtattttgtctagttgcctaattttgcaggtgaattcacagaggcccaaaacaggagtttagacagtaacagcacctggctgaatgtagaaacatcttcaaatatggtgccagcagcgagcactagcttatgattcaggagagtgagaactgaatcacagagttgccagaatctaggtatatagtgctgagcagcttcagatgctgcaaatccattaggactactggatctcttcctaaatgttcattttaatatctcctccaccataaaacaagtaccttggtgtaaggtgagattatggagggatattccaacaagaaattggataatatgtctttggatgatgctgtttgccaaggcactgcgggcaggaaaggcaaacgtaagtacataaataaatattcatctcagtaaagatgaattgctgcctaccctggggtgcaaagtgtctgatgtaatcaacttgccaccatgtggtcc

SEQ ID NO: 71671 - DNA, 2037 bp, Homo sapiens
attgtgtatgattcgttgttgactgcagcatcactaggtgggacatcactgcgttttccttgaacttccgcgggttctcctaaagttacttggtgactttttatgattgctttctgctcgtctgaataaaggatgagcccagggcctgctgcccactgtctgctctgatgaccctctctcccctgcagatccgagtgatggtggacctgtgcaacagcaccaagggcatctgcctcacaggaccttctggaccaccaggacctccgggagccggcgggttgccaggacacaacggagtggatggacagcctggtcctcagggcccaaaaggagaaaaaggagcaaatggaaaaagaggaaaaatgggtatttttggcaactcttctaattaatttccctgttatttatctccatgattgcatttgggtcgactaaaactgtgtgcagcaggggtaaggtgtttcatctctgcacagtttaaggccggtttaactcttacctagaagccattgcgttccgggataccaagggtatacttcttggtcccaccttgacagatgtttatttcaaactggagaagccgtctcctgggaactgactcgcacccttctgctgcagatgggaggtggaaggagcaggagcccacagccctgggaggggcattctgtgggccgtgtgacagctggtgctggtgcatgctctttcgaggctcagctcctgccttgccctctattgcctcctcctgcccagcgaatctgtgtttggttgaaaatcaatgaactgatgttggcccctggtaaggcatttcttggctagaggaatagctcaaactgcttgagtggaaaggcagcatcctggcctccctgtggccggcactcaggtcaaagggtctcctcttcaggggctacaggataactatgaagatatggctggcatctcggaggagcttcctttgccctgttatgagcaggccatcaccactggagaaaaggcccagaagcaccaaggcatgagatgtgcccagggagcagtaagaatcaggggctggtgcagggcctggcaggaggctggggcacaaaggggaagattctgaagggctctgagcaccagtcctggggagccggggtcagggcagatccacctgaagaaagctggcacatgctgtggtgggagctcaaagacagagggtaagaaactactcaggaggctcctacgaaggcctggctctcagccacccgtcaaagccactgctgagggcagagggaggttgttttcagccggagactccactgcaccatcttattttcaacctcttggctctgctacccaaactcacttggactggccctggacgagaagaaatggtagaaaattcttccagacagcaattactcctttggtcacctccactcttattctcattagcaattgaagtaagggccagtggagagggaaaaattgtcgagcacctctgacacttggcagtgcctacctgcttgtgttccagagggcagcttcagagaaaacgggcacacaccgtccaagccagctcaatcctcagaaggccagtaattaccattggaattacacagcagcaatggatcgttcatataggataataattataattatacatgagcatcgctgtagaataatgatgcctattggcttatcctgggaagactccaaaaatgtgattcagtcctgaggcctcggcaatgggcatgatgagggcaggctcaggggcaggagggcaccctgctagagctgggtgtggggcacgtaggaaaggggtggttttcaaaaaggcttgagacagatccctggccttgaggacgtgcttcgcatgcagcctgcaacccagggagtgcagaaaagaaaaagtgcatttgtttatggagcacatatttgtgtggcaggtaccattctagatgctggagattcagaaataagcccccctcctccaccttcacgaggcttacatcctagctgggagagacggataataaataagataaataaatagaatatatggtc

SEQ ID NO: 71672 - DNA, 522 bp, Homo sapiens
gctcgacttttttttttttgagacaagccactgcatcgcggcctgtattacacgtatctttctaaactactgcaagtgatttcagataaaaatatttcactgtggccgggcatggtgactcatgcctgtaatattaatctgtacagtctcttcacaaatatgctagtaattaccaggtattcccattcaacctcatatgcatgacattagagcttcgtgtcactagagactaaaacaaagactactgagaagtcagtaagaaagcagaaccacaatgaaataagaagaaaatagtgcttgccgtaataacaaaaccagcaaactttggacctaaagccagaaatgcaacctagactgtgaggttcaattaaagaacacagacaaagttctgagaggcatgttaggcatggggcaagaatgacaggtcagtattcagatatccaaacagagtggggagttactaaaatatgcactcacttcaagtgtgcgaggcacaagagatgagagaaggtgcacactgaa

SEQ ID NO: 71673 - DNA, 459 bp, Homo sapiens
ctttatttctcaccgcacaacaggtagcgtgaactttatgttcaagccaattccccctgctccccaagtcccatggggatgatgtggccctgatgcacactgggcgtgcagtgagtttgggtcatgcccaaagacacctgagcttcggaagcccaagccttttaaaatggtctgtaagcaaatgtgctctttaccttggagggagacattatctttagtattatttatcgtagtagacagtattaccttactagacagtaaacaaatctgctgtctgctccagagagacactatctctatcttccaaatatccttgaatagttttttctgaactgatgctgtcagggcctctgctcacaaaatatgcaaaagtttgtgagtcccatggagaattatttcccactagtggagaaacaatttaagactgagacgtttcagaacgctagaacattggaatcc

SEQ ID NO: 71674 - DNA, 307 bp, Homo sapiens
gtgttgtttttctcccttttccttgtttttacgtttttggaatgtgaatataaactttatggaggggcctggtctctgttcacaccgggtgctaataacccacagctgaaagcagaggctcagaggaaacccgggaggtgcagcgcgcagaaggctacaggaaccggaggggcgggcacgcggctggaggagggggccgggacgatatttaatatttaatttgctgggttttttttttttttaatgtggaaacttttagacacaaactggcccctgtgtttaagtcattaaaacatctttaagcatt

SEQ ID NO: 71675 - DNA, 269 bp, Homo sapiens
ttgccccatccaaccagtctcagctccaccatttgacacacacaattttataaggctcaaaacaataaaattaccttcagagaaatttcaacacagtgtgtattggcaatgatgatatgtttgatgatgatgtacaagctacaaaattatttagcagatatctaaattatttaatcagtgttgtatactgtatttgagttttaatatgtaaacttctttgattagaaagagttgaatttcaaacatcccatctaatatttcatatttcc

SEQ ID NO: 71676 - DNA, 653 bp, Homo sapiens
agcggcctgttgggaaaggtctgagggtgtcagtgggaactgcctgctttgctgaggaagcaaaggcttgtgtgggaaggaagatcacagctggtccgcagcctcaaagagcaggaagcaggacagaaggagcccctcggtgtaccctgcagcccccagccagggagaagcagcaggagacagagctacttcctctaacccagtggtggttcctaactcccaagacatcctggaccattggttctgagcagcaatcattgcaatttgctcttttctgcagccgtgaaactaccaggataaagtaatcagagtgatcccatgatgtgctggggcaaactaaacatttctcgtcaaaataatggtcagtttcctactgaatgctacatgataagtgcagtatgtttgattatgacatcagtgagtttgctacttagaggatatttatgggtgatacattgaaatttacctttgaccatctgttttggcagaaggtgtctctccaatatccaaaacttggataatccacattaaaactaattttattgtggctaatttttgttaaatgttattaaaaataataatcacattgtatttattaaatatttgttaaattttatagaatttattaaattttgttgatcaccactaaaaga

SEQ ID NO: 71677 - DNA, 362 bp, Homo sapiens
tggccaggctggtcttgaactcctgacctcatgatacacccgccttggcctcccaaagtgctgggaatacaggcgtgagccactgcacccagccttgtgtgatcttttaaagtacagttcccatagatttacattaagaataaaaaagtcatgacatcttgcttttatatggcagtttactcaagctttttaaagaaagagcattcatcttgcttttacgtggttttagaatgttgaaaaccttttgttaaatctgagtaatttactgcattttccattaattcagcttagttagactgctggatccagtgcttgtttgctgtcacatatacctaatatgcttttaacatatgccaaattct

SEQ ID NO: 71678 - DNA, 200 bp, Homo sapiens
atccagcggttgtcagctatccaggctcatgtggtgcctgtgatggtgttacactgttggaagagcaaacactgtctttattgaggtttggctccaagcactgttttggtgttgtagctgagtacctttgggcagtgttttgcacctctgagagtggaatgactcctgtggagttgatcctagtctgggtgcaaacaatt

SEQ ID NO: 71679 - DNA, 353 bp, Homo sapiens
gatagagtctcgttctgtcgcccaggctggagtgctgtggtatgatcttggctcactgcaacctcgcctcctgggttcaagcaattctcctgccttagcctcctaagtagctgggattacaggcgcatgccatcacacccggctaatttttttatttttagtggagacagggtttcaccatgtcggtcaggctggtcttgaactcctgacctcaaatgatctccctgccttggcctcccaaagtgctgggattacaggcatgagccaccgcacccagccttgatgccaaatttaatgcccaaaaggaggttgtgagctttgggcctgacagatgctgctttaaataaatatgt

SEQ ID NO: 71680 - DNA, 1355 bp, Homo sapiens
agtaacacaaagcatcatacctgggactgggaaggttaatgtttaaacattttaaatgtggcattggtttgttgaagacagtcaagcagtaggtgctgcaggctttgttgaggctagaaagctgttggtctttattaggtgatggcaaaacaatggatcacattttcatgtgctgtgtcttgggaggcaaatgatgagaatgtaggattggggaaaatggtaaggaaaatccaaaatgttcatgttttctaaccccttcatgccaatcttaaaagaaggacaaacaggctagattaagcaagtctacagttacaattggaaggaaacacagccgtactaaggaagtactctgtctgtggcctgcagtctagtttgactaggtcctgtatttgagctttgaaagagtaaagaatacaagtgctcgtatacccctgaagtagttaccagcagtgactgcaaggaggtaatcttatgggatgaaactataactctgtattaaccatcatatatagcatatatgtgtatatgtatgtgtgtgtgtgtatatgtgtatataaatatatgtgtgtgtatatacacacatgtacacacaccctacaacccagtgatttcaaaaaattaaacatttgtttagctcatgaatctgtgggttgggtgaacatttctattggtcttggctgggctcacctgtacccagtcagctgcagggtctagctcttcttatcttggctgggatctcacacatgtctaggatcagctgctttactagtctaggattgtcttggctgagacaggtggactactcagttctcctccactgccttatccttcagctggccagcccagaaatgttgccatgtttacagcataagagcaagcaagaaagaataatatgcaaccacttttccaagcctaaggtgaaagggcgggcagaacctgtggtgttaggaggcaactcataccagcccatgggtctactgtttaattttcagaaatttggcaagctgattgttaacacagctgttgtttaatttatgtacttgtaattaaataatttacattaaaacaaagataataggtactcaaaactcatgactttctagttattttattatattttactattgtctgtcctcttaaggtgtttgtttctagtgtatctggtggaaacactacttcatgtttcagttgtgtcaaaccagtagcttgaaatcagccactgttggagtgtttataccacagaaattgatagaagctacaaatgaagtgttgcttgttgatttgttttgttaattgtctggcttaagaaagtggtagagaaaacattaatgcagattaaatttaaaagcgtgttg

SEQ ID NO: 71681 - DNA, 1085 bp, Homo sapiens
agtaacacaaagcatcatacctgggactgggaaggttaatgtttaaacattttaaatgtggcattggtttgttgaagacagtcaagcagtaggtgctgcaggctttgttgaggctagaaagctgttggtctttattaggtgatggcaaaacaatggatcacattttcatgtgctgtgtcttgggaggcaaatgatgagaatgtaggattggggaaaatggtaaggaaaatccaaaatgttcatgttttctaaccccttcatgccaatcttaaaagaaggacaaacaggctagattaagcaagtctacagttacaattggaaggaaacacagccgtactaaggaagtactctgtctgtggcctgcagtctagtttgactaggtcctgtatttgagctttgaaagagtaaagaatacaagtgctcgtatacccctgaagtagttaccagcagtgactgcaaggaggtaatcttatgggatgaaactataactctgtattaaccatcatatatagcatatatgtgtatatgtatgtgtgtgtgtgtatatgtgtatataaatatatgtgtgtgtatatacacacatgtacacacaccctacaacccagtgatttcaaaaaattaaacatttgtttagctcatgaatctgtgggttgggtgaacatttctattggtcttggctgggctcacctgtacccagtcagctgcagggtctagctcttcttatcttggctgggatctcacacatgtctaggatcagctgctttactagtctaggattgtcttggctgagacaggtggactactcagttctcctccactgccttatccttcagctggccagcccagaaatgttgccatgtttacagcataagagcaagcaagaaagaataatatgcaaccacttttccaagcctaaggtgaaagggcgggcagaacctgtggtgttaggaggcaactcataccagcccatgggtctactgtttaattttcagaaatttggcaagctgattgttaacacagctgttgtttaatttatgtacttgtaattaaataatttacattaaaacaaagataataggtactca

SEQ ID NO: 71682 - DNA, 269 bp, Homo sapiens
atttttagtagagacagggtttcaccatgttggccaggctggtctcaaactcctggcctcaagtgagccacctgctttggcctcccaaagtgttgagattacaggtgagatattctatattcatggattgaaagactcaatattgttaagatgtcagttctttctaaagtgattttttagatgcaacacaattccaatcaaaatcccaggattttttggtagctatcaattgatagatatcaacagccagctgattctcaaatttacgt

SEQ ID NO: 71683 - DNA, 1244 bp, Homo sapiens
  misc_feature (993)..(994): n is a, c, g, or t
  misc_feature (1005)..(1005): n is a, c, g, or t
  misc_feature (1020)..(1020): n is a, c, g, or t
  misc_feature (1027)..(1027): n is a, c, g, or t
acacctggctagcatatgggaaaatgcaactgaaggaattgttgtgaaaaaagggacagcgagtttgaaataaaagttgttagagtggtactgaggagaaaaaagaatccgagaccatgtactgcgcatacacaatcccgggcatgggcggcaactctttgatgtactactataatgggaaagcggtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggnnccatcgtgaanatggcgtggcctganaggcagncattctcttctgccaagcagggtccggtccacagccttcctgtcccgtctgggattcccctgactgaaccaccccagggccttagaggtgccccgcttcggggcgcgtgctccccgggggccgagatcaccgggaggtggtgacctggacaactcgcgggcgaattttccccggtctttgcactcgcacagggggggcccgcaggggggggcccaag

SEQ ID NO: 71684 - DNA, 1256 bp, Homo sapiens
  misc_feature (1005)..(1006): n is a, c, g, or t
  misc_feature (1017)..(1017): n is a, c, g, or t
  misc_feature (1032)..(1032): n is a, c, g, or t
  misc_feature (1039)..(1039): n is a, c, g, or t
cagcatgaagttccctctctccctcccattatgaattctgggctgtggtcctgcttgctccttgtgtgtcagattgaagttctgatgctgtcagccatgtctgaccaatcagcaaacaacaccacaggatgaaatttaaacaatgcagatgctcagatacagggctatgttgcctggaccacgaagggaaagcagaggtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggnnccatcgtgaanatggcgtggcctganaggcagncattctcttctgccaagcagggtccggtccacagccttcctgtcccgtctgggattcccctgactgaaccaccccagggccttagaggtgccccgcttcggggcgcgtgctccccgggggccgagatcaccgggaggtggtgacctggacaactcgcgggcgaattttccccggtctttgcactcgcacagggggggcccgcaggggggggcccaag

SEQ ID NO: 71685 - DNA, 1096 bp, Homo sapiens
  misc_feature (845)..(846): n is a, c, g, or t
  misc_feature (857)..(857): n is a, c, g, or t
  misc_feature (872)..(872): n is a, c, g, or t
  misc_feature (879)..(879): n is a, c, g, or t
gaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggnnccatcgtgaanatggcgtggcctganaggcagncattctcttctgccaagcagggtccggtccacagccttcctgtcccgtctgggattcccctgactgaaccaccccagggccttagaggtgccccgcttcggggcgcgtgctccccgggggccgagatcaccgggaggtggtgacctggacaactcgcgggcgaattttccccggtctttgcactcgcacagggggggcccgcaggggggggcccaag

SEQ ID NO: 71686 - DNA, 1165 bp, Homo sapiens
  misc_feature (914)..(915): n is a, c, g, or t
  misc_feature (926)..(926): n is a, c, g, or t
  misc_feature (941)..(941): n is a, c, g, or t
  misc_feature (948)..(948): n is a, c, g, or t
acacctggctagcatatgggaaaatgcaactgaaggaattgttgtgaaaaaagggacagcgagtttgaaataaaagttgttagagtggtactgaggagaaaaaagaatccgagaccatgtactgcgcatacacaatcccgggcatgggcggcaactctttgatgtactactataatgggaaagcggtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggnnccatcgtgaanatggcgtggcctganaggcagncattctcttctgccaagcagggtccggtccacagccttcctgtcccgtctgggattcccctgactgaaccaccccagggccttagaggtgccccgcttcggggcgcgtgctccccgggggccgagatcaccgggaggtggtgacctggacaactcgcgggcgaattttccccggtctttgcactcgcacagggggggcccgcaggggggggcccaag

SEQ ID NO: 71687 - DNA, 388 bp, Homo sapiens
ctcaatctgctgatctcgtgatccacccgcctcagcctcccaaagtgctgggattacaggcgtgagccaccgtgcccagcccatcttaaccatttttaagcatatagttcaatagtgttaaatatattcatcaattgagaccagaaggtcaaggctgcagtgaaccatgattgcgccactgcactccagcctgggcgacagagtgaaactctgcctcaaaaaaataaataaatatattcacacaattgtgcagaggtagattcttatacctccaactgctgcatttggtatgttgtaatatcacacaccgtgaatctctggaaaactccactgtacactcatgagagaatgagagtgaaaaaggcaaatgatgtttccttattattag

SEQ ID NO: 71688 - DNA, 380 bp, Homo sapiens
ggaagaagcagcgaccaagaaggagcgcaaaggagtgacaggcaaggagcccacagggaccacaccaatgcaacaggaagaactacggggatgggacaggacaggacagggccggggggagggggcgacagggatggagctggtccagccaagtcataaccagcccctccctggggcgctcgctgcgcgcagggcgccgcgctgggcactttggagcgttctctcccggagtcccccccaccggccatccgatgccccatttcagagactggaacggggaggccggccccgcatcgccagttccgcggtgtcacccgcacccaggacagcgacgactcaatgcccgaccctcccggacgcaggaggtcgctggcggccgc

SEQ ID NO: 71689 - DNA, 309 bp, Homo sapiens
atcatgccatcgcactccagactggatgacaaagtgagactctatatcaaaaaaaaaaaaaatagtgctctagtaagtctttaaaaggacacacaatcatctttttacattttttcaatttttgtgtaattcttcaaaacactagtttctatggtcgcgcatacattggaaaggtaacagtgaaaagataattaaaacctgggttcaaattctcacctcacaattcgacctctctgagttcttgcaaaggtaacatgaaaaggtttagaaagggctagaaagcaattgattcccaataaatattggttc

SEQ ID NO: 71690 - DNA, 335 bp, Homo sapiens
ttggcaatttgattggcaaaactttaactgttgataatatccagctttgataaaggtatagagaaaaggaaccttctctatgctgtaattggaatgtaaattcgtatagccctataaaggacaattggcattatttatagataactaaaatgcttatgagttttgactcaggaactctactcctgggaatctctcctgtagaaatgtgtatattcccaaaggtactcaaaataagtttgctatagtgttatttataatagcaaaaatttgagaaaagcataaatgcctgacagtggggaaccagatacattatgacatctacataataaaatact

SEQ ID NO: 71691 - DNA, 1874 bp, Homo sapiens
aaaaattgaaggaatggggtttacaggctggaagtccgcacacagactgggcaggaccgcgaggcttgccaacggtgctggagggtgtcccagcttcaagttcagtcccctgcttggtgcccatgagggacgtcccaagctcatcccttcctccagcgctgctttctctggtgcagagttgctagaaacattccccgtcggaggggaaaggatttggaggcggtgggctgtcggcccgggctagtcccaaggagggcgtggcgttcgtgtgactttcctttacccacccccgggaatgtgtccctcttctgatccattgtgcccgtggacattttaacaaaggctatgactgttttgtaggcagtggcgggtgacagtgggagggggtgcgtgcgaggtcggtcgcggtgcggccctgggggatgggagagcggggggagggggaggcggcgtggggggaagtgaaaggaagagaaacagtcttcctgcttcaggtttttccttcttcctggtccgctgaatttgatcactggtaggaacagccccaagagggatatgactggaaagtagtgtgtgcgcgtttggactctggctccagccactggtttttgtgattgtgctgtgcaagtattttctacgagtccctttaggagaaaagcgaaactaatgggatttgagaggaaataattgaatgaaaggatgaagaggttgagtgacaaaacttagagcttaattatttgtctgttgatggtcatactataaagccagactttgaaggatgcgaaggtgttcaagccagggtaagtgaaaagttggttaggctactgttgattgtttcaatcaagagtggattattgggcatgtgtgtggatgtgctgtcaagatcttgggccgactcactttagaacctttgaaaataatattaaggatacaaaacattagggcaaatattgtaatattggataaagctccatatgctttcattttcaaacttagggacttttatgaaagatagtatatgtgttcccaagcatagatgttgatatttttactcatttgttttaagttaatacaacaaaataaactgaacttcctcctctccacccctttccctcgattgtaaatcccgttttataaacgtttactttctgatctgaagtatacttaaaaacacaattaccccgcccaacccccacccctgcaccaaccccaggcatgaggtgaacaggatttcttctggttttattgttatgttattctttctttttctattttcccaaatttggggcaggtggagggcggggagtgttagggatgccttttctcttttctagtgcctgatgaactcctattcatctttctagacttagcctgattcacttcttgaaaaattttgccatcttctccagagtgaattaatcacacccttttctgttaaatttatataacttgccttatttctccattactactagaacctcagtcttttgtgttacccttgtacctagagctgcctggcatgtgataagcacctaataaactaacttacagatatatattaataaatgctgttagaaagatggtaattcataggccgggtgcagtggcttactcctgtaatcccagcactttgggagtctgaggcaggtggatcacaaggccaggagatccagaccatcctggctaacatggtgaaaccccgtctctactaaaaatacaaaaaaattagccgggcgtggtggtgggcgcctgtagtcccagctactagggagactgaggcaggagaatggcatgaacccgggaggcggagcttgccttgagctgagatcgcgccactgcactccagcctgggctacagagcgagactccgtctc

SEQ ID NO: 71692 - DNA, 821 bp, Homo sapiens
gagccgcgggctgctttgtgacgcgtcgccatggagacaaggatcgggttccagggagttctgcccctgccaaggggtgctggccacgcaggaggcttaacctggccggcgcgggaatggggtgcagagagcaaagaaatgtggctttgatcttatggatgccttacttttacattatttgtacagttcttgcagtgagctttccggaccactgtcttgtatgtttcctaagaaaagcaaaaagggaagagattgaagagaaagtagattttcaactacaaactttcatccatttgctttcagcttaagcaaatgtgcgcaaagttgtcatggatttttgcagtcaataaaaaccaagcaagaagactgaatcccaagtcatctggggcagataagaaaagaaacaatttgctgaaactccctctgcttataacaaaactgactgaaatcagccggaatcaatatggccaaatgcagtttgcgcacagcaagcttgctgatgtcacagcctgaatttctactgcatgtttcatacgaactccctccaaatttgcacatgagacccaccaggaagcatgaagagagagccatgcatgcctgaagacttcccagatgttccctttgcttccaccaatcacctgctaaccccaggatccaaccctaaaccttttgtaataaaattactgccctaaagccagtacaagacagatttgaactggacttttgtttcctcagaagttaacttgcaatgtgaagctttccttttctcaaaaacttggtgtcatagtgttggcttctagtgcagtgagccccttttgctg

SEQ ID NO: 71693 - DNA, 528 bp, Homo sapiens
aggaaatgcacgcgtggaaacaggagtgggcagggaggatgtgacactgtcctcctcaccaggccacgttcctggcaccaaccatagtgtttgggcagataagaaaagaaacaatttgctgaaactccctctgcttataacaaaactgactgaaatcagccggaatcaatatggccaaatgcagtttgcgcacagcaagcttgctgatgtcacagcctgaatttctactgcatgtttcatacgaactccctccaaatttgcacatgagacccaccaggaagcatgaagagagagccatgcatgcctgaagacttcccagatgttccctttgcttccaccaatcacctgctaaccccaggatccaaccctaaaccttttgtaataaaattactgccctaaagccagtacaagacagatttgaactggacttttgtttcctcagaagttaacttgcaatgtgaagctttccttttctcaaaaacttggtgtcatagtgttggcttctagtgcagtgagccccttttgctg

SEQ ID NO: 71694 - DNA, 4343 bp, Homo sapiens
  misc_feature (1475)..(1475): n is a, c, g, or t
ggccctgcctacagcccgaggccccgcccccggcgcccctcccagccgtttgaagcggctcgggctgcggctggctcagagtggcgcggggggcgtggggcggtgctgaggagctgaagccgtggccagctcgacgccggacagtccagcgagcagcacggcgggaaccggcagccggagcagtcccggagcagaagcagcagcagcagcagcagccctcgccgttcgcggagcgcagccgagccggccatggcgttgtcgatgccgctgaatgggctgaaggaggaggacaaagagcccctcatcgagctcttcgtcaaggctggcagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtangagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagcgttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattctttctggtgattctgaaccttgcctcatagcttaaagtataaaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgacataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttctttgtaattttggctttcacaatttatctttaaatccttgagcaatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattggtacatgtgggcttttaaaaactccatcctttataaatagtcaaggtttgggccacacaaagtatatttttatcatggaaaaatttcaactcctcaagccgtaatgttgaacagaattggagtattttctttataatttcttgaacaggcaaatgaaagcttattatagaatgcatgtattttcttttatctttggaacatcagcaccagtatattgctggcagctattgtattaaaaaataaagtatattttcactatcg

SEQ ID NO: 71695 - DNA, 2801 bp, Homo sapiens
  misc_feature (1475)..(1475): n is a, c, g, or t
ggccctgcctacagcccgaggccccgcccccggcgcccctcccagccgtttgaagcggctcgggctgcggctggctcagagtggcgcggggggcgtggggcggtgctgaggagctgaagccgtggccagctcgacgccggacagtccagcgagcagcacggcgggaaccggcagccggagcagtcccggagcagaagcagcagcagcagcagcagccctcgccgttcgcggagcgcagccgagccggccatggcgttgtcgatgccgctgaatgggctgaaggaggaggacaaagagcccctcatcgagctcttcgtcaaggctggcagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtangagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagcgttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtattttctttataatttcttgaacaggcaaatgaaagcttattatagaatgcatgtattttcttttatctttggaacatcagcaccagtatattgctggcagctattgtattaaaaaataaagtatattttcactatcg

SEQ ID NO: 71696 - DNA, 1023 bp, Homo sapiens
ggccctgcctacagcccgaggccccgcccccggcgcccctcccagccgtttgaagcggctcgggctgcggctggctcagagtggcgcggggggcgtggggcggtgctgaggagctgaagccgtggccagctcgacgccggacagtccagcgagcagcacggcgggaaccggcagccggagcagtcccggagcagaagcagcagcagcagcagcagccctcgccgttcgcggagcgcagccgagccggccatggcgttgtcgatgccgctgaatgggctgaaggaggaggacaaagagcccctcatcgagctcttcgtcaaggctggcagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgt

SEQ ID NO: 71697 - DNA, 2839 bp, Homo sapiens
  misc_feature (1513)..(1513): n is a, c, g, or t
ggccctgcctacagcccgaggccccgcccccggcgcccctcccagccgtttgaagcggctcgggctgcggctggctcagagtggcgcggggggcgtggggcggtgctgaggagctgaagccgtggccagctcgacgccggacagtccagcgagcagcacggcgggaaccggcagccggagcagtcccggagcagaagcagcagcagcagcagcagccctcgccgttcgcggagcgcagccgagccggccatggcgttgtcgatgccgctgaatgggctgaaggaggaggacaaagagcccctcatcgagctcttcgtcaaggtaaatctcaaatttggattatcaggctaattggaaaggctggcagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtangagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagcgttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtattttctttataatttcttgaacaggcaaatgaaagcttattatagaatgcatgtattttcttttatctttggaacatcagcaccagtatattgctggcagctattgtattaaaaaataaagtatattttcactatcg

SEQ ID NO: 71698 - DNA, 2748 bp, Homo sapiens
  misc_feature (1422)..(1422): n is a, c, g, or t
ggccctgcctacagcccgaggccccgcccccggcgcccctcccagccgtttgaagcggctcgggctgcggctggctcagagtggcgcggggggcgtggggcggtgctgaggagctgaagccgtggccagctcgacgccggacagtccagcgagcagcacggcgggaaccggcagccggagcagtcccggagcagaagcagcagcagcagcagcagccctcgccgttcgcggagcgcagccgagccggccatggcgttgtcgatgccgctgaatgggctgaaggaggaggacaaagagcccctcatcgagctcttcgtcaaggatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtangagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagcgttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtattttctttataatttcttgaacaggcaaatgaaagcttattatagaatgcatgtattttcttttatctttggaacatcagcaccagtatattgctggcagctattgtattaaaaaataaagtatattttcactatcg

SEQ ID NO: 71699 - DNA, 516 bp, Homo sapiens
tttttttagggcattcgaaagttgttaccttaagccaaaaaactattgaatttactctgcctactgtgaccaatacaattggaaaacctacctataaagtgttacatgctgctgcccgaaaatctgtaccacacccatacttttgagaatgaaggaaattctgagcaagataagcaacatgacaaattcagaaatgcaggaaaggaaattgcaagtatagaagccttttgaaaataatactgactcgtgtggatggtgcttattgaaaaacagctggaaatacagtggatcaacagggtaggcccagatcacagaaggcctgaccaggcagtgaatgtgtctttaccatatggaacaattttgaacttctaagatcaagcctttttgttgctgagggtaagaaaggagctctgtgatgaggttccagcttacttctattcgccagtgtccctgtaatgctttctggtgtgatgtaaaatcaattaaacaaaacttgtgctctgcaaaaaaagaaaa

SEQ ID NO: 71700 - DNA, 362 bp, Homo sapiens
gttaactgtattgtccataagacagaattcaagaaattcaggtctgcctgactccagagcccagtattcctaaccgttataccaaactgtaaaatgaaatttaaaaaaatgtcaacccagtataaatgcaagtaaatttactttcactgttttgaatcagcatgtaatttattcactaagcaagtccaattgaatcagtgaattaagaactattcctttaattcttaagatattgttatagtaatggattcaaattgcctgagttcgaatcccagtaccagtcaagtactgtaagcaagtcacttagcatcagtaagccttagtttccttgcctataaagtgaggataaaagtgtctgctat

SEQ ID NO: 71701 - DNA, 364 bp, Homo sapiens
ggaattattttttaacaaacatgcagtggagcacatagaagccagcggtatttgagaaatggggcccaggattaattggttggtatggaaattaaccaagttggcctactatagtcccagaagccttgtccattaatcatacgaatgagtgctgaactctggtgccccccgctactcctcattctctggtgtcatctgttgctgtcctgatgttcattattgcctctggttggagctgtaaagtttcttgacatagggtactatgtcacattctttttcagtaaaatcttacaacttaagacaggtataaatatgctggcaagtacattcttttgtttgaaggctatctctagacttatttttg

SEQ ID NO: 71702 - DNA, 299 bp, Homo sapiens
ctcgcccaacgcggagccctgccgcgcctcggccactgggcagctctgcctgtccgcctgctcgaggcttctgggttgaggggtcgccgacccttgagacggagtcccgggaccatccggacctctggcccaaggatcgtagagtcctgcccgcccggcacttagagcggcagtcgctccagcgctcctggccccgcgcctcgctcaggccgccccccaggcgacccggcccagcccggggcgcaggtgggagaggtgagaggaggctccggagtcctcgcctggtcctgggcggccgc

SEQ ID NO: 71703 - DNA, 395 bp, Homo sapiens
acattcttttgagcttctgattagcctctccaaaggaggcaatcaggcatccctttatctcagtgagcaaaggggtgactttgaatagaatgggacgcaggtttgccctaagcagttcccgatttgacttttctctttagcttagtgattttgggggcccatattttcctttcacaaatgtaaatggattaaatgtccactattaaatacatattggaagaatggattaaaaaaataatccaactaaatgctgactataagaaactcaccttacctataaagacacatatagactgagagtaatggggcgtaaaaagatattccatgcaaatggaaaccaaagttgagcaaaagtagccacacttatatcagataaaacactttaaatcaaaaat

SEQ ID NO: 71704 - DNA, 201 bp, Homo sapiens
ggcacccataatcatgtctcaaactttgctgaatgctctgaatctactgtttctacaatggcttgacttttacttttgtttctactgatgtttaccttaaaattttataaagacatggttacatttatcattggaattaatttaaatagtttccacttccttttgtgaatgtgaacattttgaagactttctcaatcctcc

SEQ ID NO: 71705 - DNA, 358 bp, Homo sapiens
ggtctttaagtttggtgatagttctgtgaccagaaatatgtcagaggaacttagaaaactcagtgtgttccaatatgacatttgctttctgtagctagcttctttccttctttgtttacatacctggatggctgaatgatctagtcgccttgcttcttgtctactaacttctctctccttggtagtagttaaaaacacacactttcaaaggagttcagtggtttctaaaattatttttatggtatagtaaataggctctcaaatttacatagagttttattgtttataaaatattttatatatattttctttttaggatttctgtaaagtagagagggcagacattattttatcctgt

SEQ ID NO: 71706 - DNA, 340 bp, Homo sapiens
tacagttaacaataatatattactatagttgacaataatatctgctatatagataatatataatagtaatatattaataatactatagttaacaatatactatagttaacaataatatagtttcaaatagctagaaggagaatattgaatgtttccaacacaaataaatgataaatctttgagatgatgtatatgctaattaccctaatttgatcactatccattatatatatggaaacatcaccatgtatcccataaacaggtataattattatgtgtcaattaaaaaataaaataagtagacaaagaagcattagaatgcaaacaataaaaataaaat

SEQ ID NO: 71707 - DNA, 409 bp, Homo sapiens
gtccatttcttctaagctgccaaatttatgtgtgtagagtctttcacagtatccactccttcttttgatgtcttcagagtcactagtgatatcccctttttcattcctgatattggtaatttgtgtctactcttttttactttgtcagtctttttagaggtgtgtcagtgttattgatttttttcaaagaaacagctctttgtttttgttaatttttctctgttgtttttctgttttcagtttcactgatttttattgatttctgcttttttattgtttcctttcttctacttgccttttatgtgttcttaaggtgagaatttaggttactgattttaaatgtttcttcttttctaatatatgcatttagtactatagattaccctctcagttctactttacttgtgtc

SEQ ID NO: 71708 - DNA, 382 bp, Homo sapiens
aaattgatatcataagcaatttagaacactgtggcttatttaacaccttaataatcagtactgttttgtaacttaaaatgaaggattctaaacattgaatacacctagtagccaatattaaataacttgcaaataaaaaatatttttaagaaatgcttggaaatttggagctatatctatttggagggaacttgtaaaaattgatcatttaagaaaatatcaggcctggatttttaaaacatcatttttacactcactcatggagttggtttagagaaactcaacatccttatttgtttgcagtagctatttagaaaataaagtttaaccacatatgattttctagaattaataccacaggcacattttatgagcatgaaca

SEQ ID NO: 71709 - DNA, 326 bp, Homo sapiens
caagtggacaaaatattcaaagtagttagtccaaggggaaaagaaccaaccaaacaggagcatctctgaattaacaacttggtccctaaagcatctgctgtcttccctttggcttttcttggttaatttagggtggcattaacttgattaggattgctttaggccgtgctgatgggaatagtcagttggctcttccttcttggagagagggagtgcgacaataaaatttgcaatacttccggtaaacaaacttctgttgcatgtcaactagagaaactcagtctttagttgactctaggaacacttcaggccatcatatattactg

SEQ ID NO: 71710 - DNA, 296 bp, Homo sapiens
aaactgccatccaggaagtgagcaggggtgacagagtgcccatgacactgggactctaccgaagcccccagctcagccagaatgcccgtccacatgagcctgagcagaaggacacacttctctgagcctccatttcctcacgggcaataattctcgcctctcagggctatgtgagcaagaaatggggttgcacgggcaaaacacctcccacgggcttgcccaagtgttgcataggacacacttgcactaagagatagagtatgggacatagttctaccaaaaaagtgtttgttgtt

SEQ ID NO: 71711 - DNA, 536 bp, Homo sapiens
cttcgacgtaggcgctgtgggcgaaggaaaaggcctggcctgctgcctcttctcttgcagcaaaatccgctgctgtgaaggagctggtaggcggacgctctgtagatagagaatccctgatctgcctgggcatcatcttgctctttatgacctgcttggctgccactgtgtagggcctgcttaaagtcctttgcactctcagcattgccctcaagttcaaggacaagcttctcattatggcaggcataaaactctttataattcgtcctccactctcccagctcagggctccagctgttgtctcacacttccttgaagttccctctgctgagtcgcccttgtgcctgaccaacttacttactaaaataaaaatcccaatttctttccagtcatgtgtgcccaagggcgagttatttaacttttctgagctttcctcagtaaaacgaagctacatatcttgcaaggatgtgatattaaagttatgatattgtaaaacaggtgccacggtgcttggcctagggtgagccttcaaccta

SEQ ID NO: 71712 - DNA, 311 bp, Homo sapiens
ccattgtactccagtctgtcacagactgagatattatctcttaaaaaaaaaatggctgggcttactttgggaggccgaggcaggtggatcacttgagcccaggagttcaagatcagcctgaccagcacagtgaaactccatctctactaaaaatagaaaaaattagatgggcgtggtggcacacacttgtaatcccaactattcgggaggctgaggcacgagaatcgtttgaatctgggaggtggttgttgcagtgagccgagatcgtaccactgcactctagtctgggcgacagagcaagaatctgtctc

SEQ ID NO: 71713 - DNA, 241 bp, Homo sapiens
tgattgaaaaaaaagtcaaaagaatatataattaaagaatatacaattgcatatataagtttgaagtttaagagagactagactagagataaaaatttggaagttgatatgtagatggtttttaaagcccatcatgatcatgatggtgaaataatgaaacaatatcatgaatgtgaaataataggaaattcagatttcagtgtccataaataaagttttcttgggacgttgctacacttta

SEQ ID NO: 71714 - DNA, 494 bp, Homo sapiens
agtattaggctctgaacgaaagtggaaacaacagaccctgggccattttcttgagagctatctggatgtaaaatttgtgggtactgcttaccaactggataagggttgtgaaaatcaggaagttaactgggtggatgttggtttcatttactaaaactggaatataagaggaaaggataaagaaggagtagtccagaaactggtggagggttagaaacaaactcaatgttagccagtctgagtcacaggtatctgtggaggaccttaaagagaggtaaggtaaggaaaaagcaaatgtaacagcacagttttctcatcaaagattttatttattttgcaagtaaatcagataggagaagctaaaaaacagatttcaatgaattaagaattaaaaacatgaagtaacataataacatggtatatgacaaagtatgaaaatcaacataacttgatattttataagaactataaaatatcaggaaaaaaactttcag

SEQ ID NO: 71715 - DNA, 1337 bp, Homo sapiens
gataaatcagatggcatcaaaattcagaatttctttcaaaattagaaagacacttaacagaatgaagacaggatacagaagatgtatcttataaggggcttggagtatataaaaaattctcagaactcagtaataagaaaacaataactcagtttttaaaatggtccaaagatttgtatagacacttcactaaaaaatacatgtacatggctattaagcatatgcaaatatgctaagcatcattagtcaaaaccataatgagacaccacttcacacctgctaggatggctataatcagaaagaacaggtaagtgttggtgagcattgtagaaaaattggaaccttcatttgttacgctaggaatgtaagatagtgtgactgattttggtaattcctcaaaaagataagctgagtaaccatatgacccagaaatttcatatacccaagagaattcaaaaaatatattcacacaaaaacctgtatatgagttagcagtattatttataatagccaaatagaaacaacccagtgtccatcaactgatgagtagataaatgtgatctatttgtaaaatagaatattacccagcagttcaaaggaattaagtactgatgcatggtacaacttggataaatctcataaacattaggataagtgaaataagccagtcacaaaagaacatattttctatgatcctatttgtgtgaaatgtccagaataggcaaatctatatatagagaaattagtggttgtctggaactggggagagcagatggagtaggaagtatccactaatagttacagggtttccttttgggatgatgataatgttctaaaagattatggtgatggttgcgtaactgtaaatatacttaaaacaattgaagtctttaaattggtgaactttatgacatatatctgaataaaattgttaattaaaactactgtgagatatcattacatacctattagtgtggctaaaatggtaatagaatgactgaccgtaccaagtgtttgtaaggaggtagagcagttggaattttcatatactgctggtgggagtgtaaagtggtacaccacttcttctggggagcagaaagcaaccttccgggtacaggtgagccaaggttgatgggcagttatgcagagggagttgggatatcactgtgtgtacctgtgcaagtcctggagtgtgttgggtcctcatcagcagggctgtatgaaggtgttcattaaaacaaaactactgatagtgtggcaggagctagaaaacacccctttcttcttagatatccctccagcaccctctactggcaaagtttaactgcccctagcca

SEQ ID NO: 71716 - DNA, 394 bp, Homo sapiens
gataaatcagatggcatcaaaattcagaatttctttcaaaattagaaagacacttaacagaatgaagacaggatacagaagatgtatcttataaggggcttggagtatataaaaaattctcagaactcagtaataagaaaacaataactcagtttttaaaatggtccaaagatttgtatagacacttcactaaaaaatacatgtacatggctattaagcatatgcaaatatgctaagcatcattagtcaaaaccataatgagacaccacttcacacctgctaggatggctataatcagaaagaacaggtaagtgttggtgagcattgtagaaaaatcagtcacactatcttacattcctagcgtaacaaatgaaggttccaatttttcgtcgac

SEQ ID NO: 71717 - DNA, 685 bp, Homo sapiens
tttatacatattaaatttatgaaaattataaaatacaacacttacaaggttatagggagaagtatacagtgacagtgtaaattagtacatttgctggaacattgtctgataatctgtaataataatcataaaatcgtcatattcttttatctaaaaattccaattctgacagtttcttaaaaacaaaacaaaacagaggcaggagaattgcctgaagccaggagtttgagaccagcctgggcaacatagcaagacctctactctacaaaaaattttaaaattagctgggcatagtggcacacacctgtagtcctagcttacttaggcagctgaggcaggtcacttgagcccagagttcaaggttacagtgagctatgatcaggccactgcactccagcatgggtgagagagtgagaccctgtctctaaaaacaaacaaaacaaatttttaagccaaaacagacaaggtgtattggaagtgtttgtagagcattggtacaagggggtaaaagaaaaagccccaaacaagcaggctaagggccacagtatataatttaatgcaatttaagagttattaaaatgataaattgggaaaagcagacctaaaactgttgtctaacaatttacaggcatattaaaatattacccttaatgtggtgagaaagccggaaaatttttatcattgt

SEQ ID NO: 71718 - DNA, 408 bp, Homo sapiens
tttttttttggtaacaaaaataaaaagaaaatgtatatactaatttttcctttcttcttaaacaaaaaaaaagtatactgtataaactttttttgcactttatttttttttatttaacaatatattcttgaaagtcatttcatatgcattccttggattcattattctcattgtcttttgcatagtaccaggaagtgtgtgtaccgtagtttattcagtcagcctcctatatttaagcatttagatgagttccaatattttgcaaagacaaataatgctgcagtgaataaccttatacatgtgtactttcatattgttggaggaatgtcttcagggtaaattcctagatgtaggattgctggatggagggataaatgcatatgttatttgacttgatattgccaaatt

SEQ ID NO: 71719 - DNA, 555 bp, Homo sapiens
ggcaaaaagaatttcacagatgacaaaccttactgatgggaagcagaatcctcacgctgggaagcgtcagcctccaccactgcccagcgagtagacagcaggactcctgtgcgctgagctgagcactgtggtttttgttattttgttttagatctcctctggcaaacacgacatataatatttttataatggatggaaagacatggtggcacaattctgaagaaaaaaatttcacaaaacttgcaaaaaaacagaaacagttgaagagcagctcctgtgtctaagccaggtcgtggggccgtcaaaccaggacttgaaaccacaatgcgaggacattctccatctgcgcaccacagggaggcaattccatttctgcccgggaggtgtattctacaaaaacgtctgcttcccatcccaatttgaatggaccaagaaaaactgctttaccataggacacttgtggcaatatggcaccgatggctggcgtcggtgaacccgacagactatggatttatcatttaataaagcattgattcattttttcagtcaaacatt

SEQ ID NO: 71720 - DNA, 1482 bp, Homo sapiens
atcagaagactggcttctccatgatggtttatggactaaggcaaagatgagcagagccatggccctcttctttgttctctgctggatccaagagtcgggggtctccctatgtttcccaggctggcctcgaactcctgacctcaagtgatcctcccacctcagcctccccgagtgctgggattaaagacgtgagccacggcacctggcctgaattttcctcaaattcaaaaaatcctgatgaaggtttggctaaaatctttgatgaaattgtgctccaagtgttttccaaggttccgtatgacccatcatttgatgaaacaagaacagcagtcagatccattacaaagagagacacacaaaaaaactatgtgaaaatgagcttagcccctggtgttgtgttggaacttcagatgcttgcagacacttcatgaatgctctgtgacactcagaataggctattcccaacagaagagcttgaacaatgctgcatttgcatcaggttcaaatgagcgagaggaacatttggctaaaatatttgatgaaattctactgcaggtgtttccaaagtttccgtatgacccatcatttaacgaagcaacagcagtcagatccattacaaagacagacatgagaaaaggaaccagcattgcttggaattctcctaaaccagaatatttccttggcagtgtggacaaaattcctgataaagatcacctttcagaggagaagaattttaaagaatcctgtctgttcgacagggatttaagagagcagttaactactatagataaagaaacacttcaaggagcagctaaaccagatgctcactttaggactatgccctgcgggcagcttctgcacttcctgcagaggaacaccatcatcgccgccgtctcaggggtggccatcctcatggccatcgtgctgttgctgcttgggttggcctcatacatcaggaagaaacagccatcggacatgtattcctgaccacagaaggaagagcagctccccacagcccttcagtcctgcctgacactgcactgaatgctcagcttgcccctagagcaatggggtggagatctcctctggcaaacacgacatataatatttttataatggatggaaagacatggtggcacaattctgaagaaaaaaatttcacaaaacttgcaaaaaaacagaaacagttgaagagcagctcctgtgtctaagccaggtcgtggggccgtcaaaccaggacttgaaaccacaatgcgaggacattctccatctgcgcaccacagggaggcaattccatttctgcccgggaggtgtattctacaaaaacgtctgcttcccatcccaatttgaatggaccaagaaaaactgctttaccataggacacttgtggcaatatggcaccgatggctggcgtcggtgaacccgacagactatggatttatcatttaataaagcattgattcattttttcagtcaaacatt

SEQ ID NO: 71721 - DNA, 1231 bp, Homo sapiens
atcagaagactggcttctccatgatggtttatggactaaggcaaagatgagcagagccatggccctcttctttgttctctgctggatccaagtagagatgggatttcatcatgttggccaggctggtcatgaactcctgacctcaatggatcctcctgcctcagcttcctgagtagctgggaccacaggtgcacaccaccacgcccagatgaaattgtgctccaagtgttttccaaggttccgtatgacccatcatttgatgaaacaagaacagcagtcagatccattacaaagagagacacacaaaaaagctattcccaacagaagagcttgaacaatgctgcatttgcatcaggttcaaatgagcgagaggaacatttggctaaaatatttgatgaaattctactgcaggtgtttccaaagtttccgtatgacccatcatttaacgaagcaacagcagtcagatccattacaaagacagacatgagaaaaggaaccagcattgcttggaattctcctaaaccagaatatttccttggcagtgtggacaaaattcctgataaagatcacctttcagaggagaagaattttaaagaatcctgtctgttcgacagggatttaagagagcagttaactactatagataaagaaacacttcaaggagcagctaaaccagatgctcactttaggactatgccctgcgggcagcttctgcacttcctgcagaggaacaccatcatcgccgccgtctcaggggtggccatcctcatggccatcgtgctgttgctgcttgggttggcctcatacatcaggaagaaacagccatcatctcctctggcaaacacgacatataatatttttataatggatggaaagacatggtggcacaattctgaagaaaaaaatttcacaaaacttgcaaaaaaacagaaacagttgaagagcagctcctgtgtctaagccaggtcgtggggccgtcaaaccaggacttgaaaccacaatgcgaggacattctccatctgcgcaccacagggaggcaattccatttctgcccgggaggtgtattctacaaaaacgtctgcttcccatcccaatttgaatggaccaagaaaaactgctttaccataggacacttgtggcaatatggcaccgatggctggcgtcggtgaacccgacagactatggatttatcatttaataaagcattgattcattttttcagtcaaacatt

SEQ ID NO: 71722 - DNA, 364 bp, Homo sapiens
gaaaagccaacaggatgcctcttaaagacatctggtgattagaaacccagagactattttatattctgtacttgcctgagatataccaccaactaagcagtctgttgaggatacaggactggatatgggagatggggagtcaacattggttaaatgacttgttccatgccaggcataatcaacattcctcattacttcttcaacatcctcttgaaagctgtgctcattttacaaatgagaaaacagatttagagaaatataatgacttgtatgaggtcacatagcttatgagtggcacagagtggaaggctacctgaattcaaagtcatgttttcactatgccatgaagctcattaaagccatg

SEQ ID NO: 71723 - DNA, 353 bp, Homo sapiens
taataaatacttttcataatactgaatttaacagccacagaatactttgttgtagtttgaaacatatttttttagctaatcctttatgagtggttacttaggttttctttttttgcatttttttctctataaatagatgtggcagacattcttcaggttaaatctttgcacgtaaccatgcttttttccttaggatacattcctggaactagaattggaggccaaaaggcttgccaaactttaagatacctgcttcctattaccaggttatgttggaaatttgtacttctttgctatatatttaaaaatattggctgggtatgatggctcatgtaatgtcagcactttgaaag

SEQ ID NO: 71724 - DNA, 1656 bp, Homo sapiens
gtgttgctgtcctcttgggttccacttcggattttgaacccctgtattttcttttcaaaacccccttttccaatggaaatgctctgttgttaaaaaggaagaaactgtctttctgaaactgacatcacgatgctcccagattttatgctggttctcatcgtccttggcatcccttcctcagccaccacaggtttcaactcaatcgccgaaaatgaagatgccctcctcagacatttgttccaaggttatcagaaatgggtccgccctgtattacattctaatgacaccataaaagtatattttggattgaaaatatcccagcttgtagatgtggatgaaaagaatcagctgatgacaaccaatgtgtggctcaaacaggaatggacagaccacaagttacgctggaatcctgatgattatggtgggatccattccattaaagttccatcagaatctctgtggcttcctgacatagttctctttgaaaatgctgacggccgcttcgaaggctccctgatgaccaaggtcatcgtgaaatcaaacggaactgttgtctggacccctcccgccagctacaaaagctcctgcaccatggacgtcacgtttttcccgttcgaccgacagaactgctccatgaagtttggatcctggacttatgatggcaccatggttgacctcattttgatcaatgaaaatgtcgacagaaaagacttcttcgataacggagaatgggaaatactgaacgcaaaggggatgaaggggaacagaagggacggcgtgtactcctatccctttatcacgtattccttcgtcctgagacgcctgcctttattctataccctctttctcatcatcccctgcctggggctgtctttcctaacagttcttgtgttctatttaccttcggatgaaggagaaaaactttcattatccacatcggtcttggtttctctgacagttttccttttagtgattgaagaaatcatcccatcgtcttccaaagtcattcctctcattggagagtacctgctgttcatcatgatttttgtgaccctgtccatcattgttaccgtgtttgtcattaacgttcaccacagatcttcttccacgtaccaccccatggccccctgggttaagaggctctttctgcagaaacttccaaaattactttgcatgaaagatcatgtggatcgctactcatccccagagaaagaggagagtcaaccagtagtgaaaggcaaagtcctcgaaaaaaagaaacagaaacagcttagtgatggagaaaaagttctagttgcttttttggaaaaagctgctgattccattagatacatttcgagacatgtgaagaaagaacattttatcagccaggtagtacaagactggaaatttgtagctcaagttcttgaccgaatcttcctgtggctctttctgatagtgtcagtaacaggctcggttctgatttttacccctgctttgaagatgtggctacatagttaccattaggaatttaaaagacataagactaaattacaccttagacctgacatctggctatcacacagacagaatccaaatgcatgtgcttgttctacgaaaaaaactgacatctggctatcacacagacagaatccaaatgcatgtgcttgttctacg

SEQ ID NO: 71725 - DNA, 1955 bp, Homo sapiens
gtgttgctgtcctcttgggttccacttcggattttgaacccctgtattttcttttcaaaacccccttttccaatggaaatgctctgttgttaaaaaggaagaaactgtctttctgaaactgacatcacgatgctcccagattttatgctggttctcatcgtccttggcatcccttcctcagccaccacaggtttcaactcaatcgccgaaaatgaagatgccctcctcagacatttgttccaaggttatcagaaatgggtccgccctgtattacattctaatgacaccataaaagtatattttggattgaaaatatcccagcttgtagatgtggatgaaaagaatcagctgatgacaaccaatgtgtggctcaaacaggaatggacagaccacaagttacgctggaatcctgatgattatggtgggatccattccattaaagttccatcagaatctctgtggcttcctgacatagttctctttgaaaatgctgacggccgcttcgaaggctccctgatgaccaaggtcatcgtgaaatcaaacggaactgttgtctggacccctcccgccagctacaaaagctcctgcaccatggacgtcacgtttttcccgttcgaccgacagaactgctccatgaagtttggatcctggacttatgatggcaccatggttgacctcattttgatcaatgaaaatgtcgacagaaaagacttcttcgataacggagaatgggaaatactgaacgcaaaggggatgaaggggaacagaagggacggcgtgtactcctatccctttatcacgtattccttcgtcctgagacgcctgcctttattctataccctctttctcatcatcccctgcctggggctgtctttcctaacagttcttgtgttctatttaccttcggatgaaggagaaaaactttcattatccacatcggtcttggtttctctgacagttttccttttagtgattgaagaaatcatcccatcgtcttccaaagtcattcctctcattggagagtacctgctgttcatcatgatttttgtgaccctgtccatcattgttaccgtgtttgtcattaacgttcaccacagatcttcttccacgtaccaccccatggccccctgggttaagaggctctttctgcagaaacttccaaaattactttgcatgaaagatcatgtggatcgctactcatccccagagaaagaggagagtcaaccagtagtgaaaggcaaagtcctcgaaaaaaagaaacagaaacagcttagtgatggagaaaaagttctagttgcttttttggaaaaagctgctgattccattagatacatttcgagacatgtgaagaaagaacattttatcagccaggtagtacaagactggaaatttgtagctcaagttcttgaccgaatcttcctgtggctctttctgatagtgtcagtaacaggctcggttctgatttttacccctgctttgaagatgtggctacatagttaccattaggaatttaaaagacataagactaaattacaccttagacctgacatctggctatcacacagacagaatccaaatgcatgtgcttgttctacgaaccccgaatgcgttgtctttgtggaaatggaacatctcctcatgggagaaactctggtaaatgtgctcatttgtggttgccatgagagtgagctgcttttaaagaaagtggagcctcctcagacccctgccttggctttcccagacattcagggagggatcataggtccaggcttgagctcacatgtggccagagtgcacaaaaagctgttgctacttggtggaggaacacctcctagaagcagcaggcctcggtggtgggggaggggggattcacctggaattaaggaagtctcggtgtcgagctatctgtgtgggcagagcctggatctcccaccctgcactggcctccttggtgg

SEQ ID NO: 71726 - DNA, 484 bp, Homo sapiens
gaggaacagagctgcctgctgactggaaccgcttcctcccagactaaggtttcccagaggaagagagagaatttggacaaatgaatgaggaacaacgctctcctgagggttttctttaaggggcaaggatcaatgcctctagatcctttgaaagcagagttaagaggcagtacaggaaggcacagcaggaaggttcatggttagactacagagaaggaagcagccactgctggggacctgccctgtgctggtcactgacaagctgtctcattaaaccttcccggaccctcaacccctcctagtatcttatcctcattttacagatgagaagactgcggcccaaataggtccaatgccagtgggatcagcttcgatgggatgcgcacagactgacctcttctccccagccccttcaacttcccagagctgcagggggcctgggagttcttggtaacagcacattaaacctctgtttgtgggaact

SEQ ID NO: 71727 - DNA, 1108 bp, Homo sapiens
  misc_feature (1)..(1): n is a, c, g, or t
  misc_feature (3)..(3): n is a, c, g, or t
  misc_feature (11)..(11): n is a, c, g, or t
ncngcccgtcnacgccaccacgggagcgagggaggtgggtctgcagggcctgagactgttctacagccactgttcacagggctgaagaacaggtgtgggcagaaccaggttgtgagaaggaagccgggcgcagagtagcggccgtacaggagggggaggggcagaagagactggccagcagcggaagcgcgcggcaggtggagccgcgcgggaagaagcacgcatgcgtcgcgggggggttggcccttggggtgctgggcggagcttgggaggggcgaggacgctgaagtaggggcggaacctgtgcggtgcagccctgccctctccctccgcccaaaggtcgcccagcgacggcctgcttgacctggtttctcaaaaagggtgaccccccccctccgccccacgctggtcgcgggtcctggcgagaagcctttcggaaagcaccggggcctgtgtgttcccgcttcctcggacgcgagctctgtgtagccgtggtggaggaaggttttgtttcgttcatcgctgctgtttctcgctgcctctcttgacgaggcaagggcccttgcagggtgcgcccgcgctgccctctgacaggtgctgttggtacctgcggccgggcccgccgtcgccggcgcgtgaacggcctgcccgaggctgccgggaggagggctgcctggccggcgcggcccttcccgtcgtgccccgggctcctcggaagcagcctcccgctccttcagacgtcggactcctgagtttcgaacctgccccgcggtttccccctcacgctgaatccaggggagccgctactcgtttttgaagttcctatgcagccctctcccgacatgttcgagaatcttgccggactggggatggatttgcagcctccgtgtttgcccccacggttcgaaaaccggaatctaggcccggtctcctggcctgtgttctgtcgtgggatttctccagagcacggactgacttaacatttccattactgggaatgtaatggttgctgcgtcaggactctggagatgatttttttatttggaacgatataatttttggaatttccttaaagggaaaaatacatattgcttaattataaaaaatg

SEQ ID NO: 71728 - DNA, 2438 bp, Homo sapiens
  misc_feature (1)..(1): n is a, c, g, or t
  misc_feature (861)..(861): n is a, c, g, or t
  misc_feature (1247)..(1247): n is a, c, g, or t
  misc_feature (1263)..(1263): n is a, c, g, or t
  misc_feature (1902)..(1902): n is a, c, g, or t
  misc_feature (2042)..(2042): n is a, c, g, or t
natccatcttgaattaatctttgtataaggtgtaaggaagggatccagttttggctttctacatatggctagccagctttccaccaccatttattaaatagggaatcctttccccattgcttgtttttgtcaggtttgtcaaagatcagatagttgtagatatgtggcattatttctgagggctctgttctgttccattgatctatatctctgttttggtaccagtaccatgatgttttggttactgtagccttgtagtatagtttgaagtcaggtagcgtgatgcctccagttttgttcttttggcttagggatgacttggcaatgagggctctcttttggttccatatgaactttaaagtagttttttccaattctgtgaagaaagtcattggtagcttgatggggatggcattgaatctgtaaattaccttgggcagtatggccattttcacgagattgattcttcctacccatgagcatggaatgttcttccatttctttgtatcctcttttatttcgttgagcagtggtttgtaattctccttgaagaggtccttcacatcccttgtaagttggattcctaggtattttattctctttgaagcaattgtgaatgggagttcactcatgatttggctctctgtttgtctgttattagtgtataagaatgcttgtgatttttgcacattgattttgtatcctgagactctgctgaagttgcttatcaggttaaggagattttgggctagacgatggggttttctagatatacaatcatgtcatctgcaaacagggacaatttgacttcctcttttcctaattgaataccctttatttccttctcctgcttgattgccntggccagaacttccaacactatgttgaataggagtggtgatttttgcaatctactcatctgacaaagggctaatatccagaatctacaatgaactcaaacaaatttacaagaaaaaaacaacccaatcaacgggctaaggatatgaaaagacccttctcaaaagaagacattgatgcagccaacaaacacatgaaaaaatgctcatcatcactggccatcagagaaatgcaaatcaaaaccacaatgagataccatttcacaccagttagaatggcgatcattaaaaagtcagggaacaacaggtgctggagaggatgtggagaaataggaacacttttacactgttggtgggactgtaaactcattcaaccattgtggaagtcantgtggcgattcctcanggatctagaactagaaataccatttgacccagccatcccattactgggtatatacccaaaggattataaatcatgctgctataaagacacatgcacacatatgtttattgcagcactattcacaatagcaaagacttggaaccaacccaaatgtccaacaatgatagactggattaagaaaatgtggcacatatacaccatggaatactatggagccataaaaaggatgagttcatgtcctttgtaggaacatgggtgaagctggaaaccatcattctcagcaaactatcgcaaggacaaaaaccaaacaccacatgttctcactcataggtgggaaatgaacaatgagaacacatggacaaaggaaggggaacatcacccaccagggcctgttgtggggtgcggggagaggggagggatagcattaggagatatacctaatgtaaatgatgagttaatgggtgcagcacaccaacatggcacatgtatacatacgtaacaaacctgcacattgtgcacatgtaccctaaaacttaaattaaaaaaaaaaagttcaaaaaaaaacaaacaaactcctgagtacagtttttgtgctgagctctcaaagagattacagaatgaacaaatcaagattcttcnataagactgaagtgctggttaccaactttcctggttaacattcagcaaaagcattttctctctaagtctggaactaggatcaggatattttcttttgtaaaattcacttgttactttcagaccaaagttgtgttttacanaaatcatgcgatcttggcactcctgattgcttggttgaaaaaatatttctgaataaaaaatattttaaatttgccattttaaaataattgtcttctttgtacccaaatgttgttttctactatttgtgattctggaaatatttgatccaggtccatcacggtggcacatatgcaactgtttgtcagtggcttctgccctcgggtctacaagaaacatccccccatgttgaacagtttttccaaaacggtttccttaaaactaacttagaagtcattcttacaaaacacatatgacacatatgaaatgtgaccacttctcactacctctgtcaatactgcctgaagtcaagccaccaacatctcataacctcctgatttccctgtctttcttcctcg

SEQ ID NO: 71729 - DNA, 343 bp, Homo sapiens
acaaatattagccaggcgtggtgctgcatgacagtaatccaagatactcaggaggctgaggcaggagaattgcttgaacccaggaggtggaagttgcagtgggccaagattgtgtcactgcactccagcctgggcgacagacactctgtctcaaaaaaaaaaaaaagaaaccatggcactatcaaactccaccagccaatgcgagaagcaggctaagaacacgcatactaggtaagtggacagtgcacatggataagtcaacaatccttcagttgcttcaatgacaaaaacataccacatacttatttcactcatctttccagggcagaaggaagaaataagt

SEQ ID NO: 71730 - DNA, 318 bp, Homo sapiens
ctatttcctgctttggtagatattcccacctgaaatatatggaaattcaactgaaagaattgtttaaggccctttttcttaggtctcatgaatcatatttcaagcaatatatgcatattactacataccattctaccgaataactcaaagatatcccaccttgtttttaggagatattgtcaaaaacactgacaaataccaaagatttcctagtcatgcttacgaatggataaaattgtttggagaactaaacaattctactatgtataattcaatgttgggattttgttaaaaaataaaattccttcaaatcttacc

SEQ ID NO: 71731 - DNA, 2488 bp, Homo sapiens
  misc_feature (2138)..(2138): n is a, c, g, or t
gggggctgttgtggtaactggcatccatcggagtagaagtgctaaatgctgtgcattgcatggaacaattccacccaacggagaattaaccctcttaaaatgccaggtgtgttcctgctaataagcactgataaaagcacaaagaaaacctaactatttgccattgtacaatggcatcagagcagccacactgcagatttcttggttgatgcccaagagtttagtgggaggaaatcactaaattatttttatctgcattttgaaggggtcaggctatgctgggaattgtttttcattaggccagagtcccacagttggatcgagctatagctctgctcaggtcatttgttggtctacatcgggacctagaagccacagagttggtgagtgcagcctgtccttgggcgctatcagatcaccccagtccccagaggggatgctggtggctggcatagtgatggagaactggccacaaaggaatatctttccagaggtttgttgtttttgtttttgtttttgttttttttggtggtggtggtggtggtgttttttgctgtaacaggcaaaggagcagaacactcagaattaaatggtctgttgtctcataaaaaccaactatgtaatcccagcactttgggaggccaaggcaggcggatcacttgaagtcaggagtccaagaccagcctggccaacatggtgaaaccccatctctactaaaaatacaaaaaaattagctgggcatggtgatgcacgcctgtaatcccagctactccagaggctgaggcaggagaatcacttgaacccggaggcagaggttgcagtgggctgagatagtgccactgcactccagcctgggcgacagggcgatactccatctcaaaaaaaaaaagacaaaaacaaaaacaaaaaacaaaaacaactatgatgctcttaaagttaaaaaataagcacagtggctaagagaaataattcagtttagctagctctcagaccactgcagactgctgcccactgatccctgcatttctctcttgctttactgtggattggctaattatttcctgatttattcatttattatctaacacacttggagtgcctgctatgtaccagtactaagaaaaagttcctgacttgggctctttatatgcgaagaagggtggcaaatctatctgttactacggagccacgtgccaggtgctaaggtggaggtgtgctcagtgggtccagagagcagagagaaagggcttcaggtgagacctggcagaggttcaggatagcagggaatctcctaagtgtcccaaatgcgctaatgtttgagctagatcctgaaagaaaacaaggagttaaccaaggtgaagaacaaacgagtggaccaggattccagagaaagaacactgtgcaccaagccacagaggcgtgaaacaaaaggctctcagttgtctagtgtggcaagtggcaggggtgcatggggggagggtgtcggagtggtgccctggagacagggagagctgcgacagattcctggggacggatccttctgcagctcaaagataggagaggcccttagacatccctcaaggccatatgtcaatcaaaataattaaaagtaaaagaaccggaaggcaggcttatatattccaacatccatctagtttttcccccaaaaaaagcttttgataaaataagatgaagtgccaaaaagatgcatgtgttcaatagcgcagcagaaagtgaatagagtaaaagtaataaaaaatactcggccgggcatggtggctcacacctgtagtcccagcactttgggaggccaaggcaggtggttcacctgaggttgggagttcaagactagcctggccaacatggtgaaaccccattactactaaaaatacaataattaggcaggcgtggaggcacgcacctgtaaatcccagctacttgggagactgaggcaggagaattgtttgaacccaggaggaggaggttgcagtgagccaagatcataccattgcactccagcctgggtgacaaggcaagactccgtctcaaaataaataaataaataaataaataaaataaaaaataatctctacaaaactgagttattgctaattctgggtagcacagcacaggagagngtgcttgggtttggagtctgacagaactgagtgcaagtcttggctttactaacttggctaatgccactgtaccagcactttgggaggccaaggggggcagatcacctgaggttaggagtttgagaccagcctggccaacatagtgaaacgccatctctactaaaaatacaaaaattagccgggtgtgatggcacatgcctgtagtcccagctacttgggaggctgaggcacaagaatcacttgaacccaggaggcgggaggttgcagtgagtagaggttgcaacaagctcagatcgtaccactgcactccagcctgggcaacagagcaagactctgtctaaaaaaaaaaa

SEQ ID NO: 71732 - DNA, 443 bp, Homo sapiens
tctgctgcactgcgctggggacggcggagggctctgggcgtgggccccgcggctcgggggcgggtcccggctggaggtagatgtgaagctctggctgcccgggggaggcggccgggcggttgagacagtcgcttgggaaacctacccgctgctcaggagcgagaacagagctccggagccgcacgcagcacaagtctggggatcctctagagtaaactgcaggctgcaagtaaggcacccccacgcccacgcgctcccacttccgctccgggacccccgggacccctcttcaggaactcgggcagagtcgtcagccagctccagggaggtttgggcccgtcaggcttgagtcgagacctgcatcattcctgaagacaaaagcagcttccctttcctccacacttgaaaaggtcacccgcaacctgtccctccgggggacgccc

SEQ ID NO: 71733 - DNA, 414 bp, Homo sapiens
aagaagagctcattgtcatctccaaaaacaaggaccacaattaaatgttttggtttttttattaacaacatgttgacataatatgtggcactgaaaataaacctttttataatgattttttttgaaaattattattattatttttaaaataaagatgaggtcttgctacgttgcccaggcttgtctcaaactcccaagcaccttcagcagtcctcttgccttggcctcccaaagtgctaggattataggcatgagtaaccacacccagccaacctttaataatgtcttaaaaatactatatttgttaagtggtaggttactttcatttaaagatgtataaataagaaagtataggtttagaaactattaaaattggaatttcttcacctgttattattttagatccaattccta

SEQ ID NO: 71734 - DNA, 578 bp, Homo sapiens
gtcaacattatttttaaagctgactcagggaaataaaacctcattgttagtgctgatatatacggtatgttatcctgttgaaaacttaacccctcttgtcctgctcccaactgaactaaataagaggtaagcactttgacagctgctgaccttttgtgcatgttttgccctatggccagtgcctggtttgcaatgggattggcccatgatgtgaagtaaagggcagcacatattcaacactcttcagagaagactctgccaagaatgagaagtgatcagcaaaaatctttgcattttagaggatcaaaaggcccgtgaaacttttctggacacataccatggagcccataacctgtatcgttgttgaacagtgagagcaatgacaagaggagaagtggtgcagaggccccagctcagaggggagatgtggaaagcatcagccatggatgctcacagagaaaagcctgagtctgggatgccagaagcaagggctgcacaccctgtcttctgcacaaaccaaccacaacagtgatttgggcttcaataaaataatcactacgaaatgaaaatcgagccaa

SEQ ID NO: 71735 - DNA, 194 bp, Homo sapiens
ggaggttgcagtgagccgagatcacgccgttgcactccagcctgggcgacagagcaaggttccatcttgggggaaaaaaaaaaaaaacacccagaataatgtctgaccaaatccctgggcacgtcatggtccagctaggttgacaagtaaaagtaagcataacactaagttagtaatacagctcagccacattg

SEQ ID NO: 71736 - DNA, 2049 bp, Homo sapiens
  misc_feature (150)..(150): n is a, c, g, or t
aattcagagccaccgcgggcaggcgggcagtgcatccagaagcgtttatattctgagcgccagttcagctttcaaaaagagtgctgcccagaaaaagccttccaccctcctgtctggctttagaaggaccctgagccccaggcgccagcnacaggactctgctgcagaggggggttgtgtacagatagtagggctttaccgcctagcttcgaaatggataacgtcctcccggtggactcagacctctccccaaacatctccactaacacctcggaacccaatcagttcgtgcaaccagcctggcaaattgtcctttgggcagctgcctacacggtcattgtggtgacctctgtggtgggcaacgtggtagtgatgtggatcatcttagcccacaaaagaatgaggacagtgacgaactattttctggtgaacctggccttcgcggaggcctccatggctgcattcaatacagtggtgaacttcacctatgctgtccacaacgaatggtactacggcctgttctactgcaagttccacaacttcttccccatcgccgctgtcttcgccagtatctactccatgacggctgtggcctttgataggtacatggccatcatacatcccctccagccccggctgtcagccacagccaccaaagtggtcatctgtgtcatctgggtcctggctctcctgctggccttcccccagggctactactcaaccacagagaccatgcccagcagagtcgtgtgcatgatcgaatggccagagcatccgaacaagatttatgagaaagtgtaccacatctgtgtgactgtgctgatctacttcctccccctgctggtgattggctatgcatacaccgtagtgggaatcacactatgggccagtgagatccccggggactcctctgaccgctaccacgagcaagtctctgccaagcgcaaggtggtcaaaatgatgattgtcgtggtgtgcaccttcgccatctgctggctgcccttccacatcttcttcctcctgccctacatcaacccagatctctacctgaagaagtttatccagcaggtctacctggccatcatgtggctggccatgagctccaccatgtacaaccccatcatctactgctgcctcaatgacaggttccgtctgggcttcaagcatgccttccggtgctgccccttcatcagcgccggcgactatgaggggctggaaatgaaatccacccggtatctccagacccagggcagtgtgtacaaagtcagccgcctggagaccaccatctccacagtggtgggggcccacgaggaggagccagaggacggccccaaggccacaccctcgtccctggacctgacctccaactgctcttcacgaagtgactccaagaccatgacagagagcttcagcttctcctccaatgtgctctcctaggccacagggcctttggcaggtgcagcccccactgcctttgacctgcctcccttcatgcatggaaattcccttcatctggaaccatcagaaacaccctcacactgggacttgcaaaaagggtcagtatgggttagggaaaacattccatccttgagtcaaaaaatctcaattcttccctatctttgccaccctcatgctgtgtgactcaaaccaaatcactgaactttgctgagcctgtaaaataaaaggtcggaccagcttttcccaaaagcccattcattccattctggaagtgactttggctgcatgcgagtgctcatttcaggatgaattctgcagcacagctgcggacccggaagactcattttcctggagccccgtgttacttcaataaagttatctcagattagcctcctgcagctggaggctcctatcaccccagcctacgcttgacagggtgaacaaaagaaggcaccacataacatctaaatgaaaaatttagccctgtcttctaagcatctgtgaaaagaaacatatgtattcccctttttggcatctcagtatttcagtacatttatacatcatgagattgagaacctcgggcttccacat

SEQ ID NO: 71737 - DNA, 1359 bp, Homo sapiens
  misc_feature (150)..(150): n is a, c, g, or t
aattcagagccaccgcgggcaggcgggcagtgcatccagaagcgtttatattctgagcgccagttcagctttcaaaaagagtgctgcccagaaaaagccttccaccctcctgtctggctttagaaggaccctgagccccaggcgccagcnacaggactctgctgcagaggggggttgtgtacagatagtagggctttaccgcctagcttcgaaatggataacgtcctcccggtggactcagacctctccccaaacatctccactaacacctcggaacccaatcagttcgtgcaaccagcctggcaaattgtcctttgggcagctgcctacacggtcattgtggtgacctctgtggtgggcaacgtggtagtgatgtggatcatcttagcccacaaaagaatgaggacagtgacgaactattttctggtgaacctggccttcgcggaggcctccatggctgcattcaatacagtggtgaacttcacctatgctgtccacaacgaatggtactacggcctgttctactgcaagttccacaacttcttccccatcgccgctgtcttcgccagtatctactccatgacggctgtggcctttgataggtacatggccatcatacatcccctccagccccggctgtcagccacagccaccaaagtggtcatctgtgtcatctgggtcctggctctcctgctggccttcccccagggctactactcaaccacagagaccatgcccagcagagtcgtgtgcatgatcgaatggccagagcatccgaacaagatttatgagaaagtgtaccacatctgtgtgactgtgctgatctacttcctccccctgctggtgattggctatgcatacaccgtagtgggaatcacactatgggccagtgagatccccggggactcctctgaccgctaccacgagcaagtctctgccaagcgcaaggtggtcaaaatgatgattgtcgtggtgtgcaccttcgccatctgctggctgcccttccacatcttcttcctcctgccctacatcaacccagatctctacctgaagaagtttatccagcaggtctacctggccatcatgtggctggccatgagctccaccatgtacaaccccatcatctactgctgcctcaatgacaggtgaggatcccaaccccatgagctctccaggggccacaagaccatctacatacacagtggccaagcggcatcctaaatgagtaaacccagctgtgagacaagagggacaagtggggactgcagctaacttatcatcacacaactcagcctggctgattatcaccatccaggaatgggagcccggagtagactgattttctttttttcttttcca

SEQ ID NO: 71738 - DNA, 940 bp, Homo sapiens
  misc_feature (150)..(150): n is a, c, g, or t
aattcagagccaccgcgggcaggcgggcagtgcatccagaagcgtttatattctgagcgccagttcagctttcaaaaagagtgctgcccagaaaaagccttccaccctcctgtctggctttagaaggaccctgagccccaggcgccagcnacaggactctgctgcagaggggggttgtgtacagatagtagggctttaccgcctagcttcgaaatggataacgtcctcccggtggactcagacctctccccaaacatctccactaacacctcggaacccaatcagttcgtgcaaccagcctggcaaattgtcctttgggcagctgcctacacggtcattgtggtgacctctgtggtgggcaacgtggtagtgatgtggatcatcttagcccacaaaagaatgaggacagtgacgaactattttctggtgaacctggccttcgcggaggcctccatggctgcattcaatacagtggtgaacttcacctatgctgtccacaacgaatggtactacggcctgttctactgcaagttccacaacttcttccccatcgccgctgtcttcgccagtatctactccatgacggctgtggcctttgataggtacatggccatcatacatcccctccagccccggctgtcagccacagccaccaaagtggtcatctgtgtcatctgggtcctggctctcctgctggccttcccccagggctactactcaaccacagagaccatgcccagcagagtcgtgtgcatgatcgaatggccagagcatccgaacaagatttatgagaaagtatgaaactacaagcctgagcaaggtcccagcgggagaaagaacacagctttacaagccatacagaacctgtgaacatgttcaagccagaaggtttcctcaaaagggaaaaaaaaaatctccgaattaaagctcgttatataaa

SEQ ID NO: 71739 - DNA, 3718 bp, Homo sapiens
acgtcaccaccagcctagctcggacggcaagcggcgggagattttcaaaatgggagcccagaggcaccgcccaggcctcggaaggtgtcagggagaactttccgtggtttcagcgtcgtcgcctggagcggcggtttagagagccgagcctgatgggcgccaaggccggctggctgcttggagcgctgcctcgaagggactgcgtgaaggaagctaatccggagaacccaggccagagcctggaaatatggcgacctgcatcggggagaagatcgaggattttaaagttggaaatctgcttggtaaaggatcatttgctggtgtctacagagctgagtccattcacactggtttggaagttgcaatcaaaatgatagataagaaagccatgtacaaagcaggaatggtacagagagtccaaaatgaggtgaaaatacattgccaattgaaacatccttctatcttggagctttataactattttgaagatagcaattatgtgtatctggtattagaaatgtgccataatggagaaatgaacaggtatctaaagaatagagtgaaacccttctcagaaaatgaagctcgacacttcatgcaccagatcatcacagggatgttgtatcttcattctcatggtatactacaccgggacctcacactttctaacctcctactgactcgtaatatgaacatcaagattgctgattttgggctggcaactcaactgaaaatgccacatgaaaagcactatacattatgtggaactcctaactacatttcaccagaaattgccactcgaagtgcacatggccttgaatctgatgtttggtccctgggctgtatgttttatacattacttatcgggagaccacccttcgacactgacacagtcaagaacacattaaataaagtagtattggcagattatgaaatgccaacttttttgtcaatagaggccaaggaccttattcaccagttacttcgtagaaatccagcagatcgtttaagtctgtcttcagtattggaccatccttttatgtcccgaaattcttcaacaaaaagtaaagatttaggaactgtggaagactcaattgatagtgggcatgccacaatttctactgcaattacagcttcttccagtaccagtataagtggtagtttatttgacaaaagaagacttttgattggtcagccactcccaaataaaatgactgtatttccaaagaataaaagttcaactgatttttcttcttcaggagatggaaacagtttttatactcagtggggaaatcaagaaaccagtaatagtggaaggggaagagtaattcaagatgcagaagaaaggccacattctcgataccttcgtagagcttattcctctgatagatctggcacttctaatagtcagtctcaagcaaaaacatatacaatggaacgatgtcactcagcagaaatgctttcagtgtccaaaagatcaggaggaggtgaaaatgaagagaggtactcacccacagacaacaatgccaacatttttaacttctttaaagaaaagacatccagtagttctggatcttttgaaagacctgataacaatcaagcactctccaatcatctttgtccaggaaaaactccttttccatttgcagacccgacacctcagactgaaaccgtacaacagtggtttgggaatctgcaaataaatgctcatttaagaaaaactactgaatatgacagcatcagcccaaaccgggacttccagggccatccagatttgcagaaggacacatcaaaaaatgcctggactgatacaaaagtcaaaaagaactctgatgcttctgataatgcacattctgtaaaacagcaaaataccatgaaatatatgactgcacttcacagtaaacctgagataatccaacaagaatgtgtttttggctcagatcctctttctgaacagagcaagactaggggtatggagccaccatggggttatcagaatcgtacattaagaagcattacatctccgttggttgctcacaggttaaaaccaatcagacagaaaaccaaaaaggctgtggtgagcatacttgattcagaggaggtgtgtgtggagcttgtaaaggagtatgcatctcaagaatatgtgaaagaagttcttcagatatctagtgatggaaatacgatcactatttattatccaaatggtggtagaggttttcctcttgctgatagaccaccctcacctactgacaacatcagtaggtacagctttgacaatttaccagaaaaatactggcgaaaatatcaatatgcttccaggtttgtacagcttgtaagatctaaatctcccaaaatcacttattttacaagatatgctaaatgcattttgatggagaattctcctggtgctgattttgaggtttggttttatgatggggtaaaaatacacaaaacagaagatttcattcaggtgattgaaaagacagggaagtcttacactttaaaaagtgaaagtgaagttaatagcttgaaagaggagataaaaatgtatatggaccatgctaatgagggtcatcgtatttgtttagcactggaatccataatttcagaagaggaaaggaaaactaggagtgctccctttttcccaataatcataggaagaaaacctggtagtactagttcacctaaggccttatcacctcctccttctgtggattcaaattacccaacgagagatagagcatctttcaacagaatggtcatgcatagtgctgcttctccaacacaggcaccaatccttaatccctctatggttacaaatgaaggacttggtcttacaactacagcttctggaacagacatctcttctaatagtctaaaagattgtcttcctaaatcagcacaacttttgaaatctgtttttgtgaaaaatgttggttgggctacacagttaactagtggagctgtgtgggttcagtttaatgatgggtcccagttggttgtgcaggcaggagtgtcttctatcagttatacctcaccaaatggtcaaacaactaggtatggagaaaatgaaaaattaccagactacatcaaacagaaattacagtgtctgtcttccatccttttgatgttttctaatccgactcctaattttcattgattaaaactcctttcagacatataagtttaataaataacttttttgttgactttcaagtaaagtgattttttttaatttaacataaagtcttcagaaagcctttctatgaaagaattttaacctataatgtaaaggatgtattctgagagaacaaagcagaatgaaacttgagtcacttactaaatatagtggatataaaatagaacacctgactttgctcttagaccataacccccgaacttactatgttcatatatttgtattgaacaatcttttaaaagcaaaaatgtaaatgatgtgtagtttatttgtgcttttattgttttccctgcgtctcagacatgttgagaatcatggacaaaacctgctggaattttggaatttttgaagatgtaaataatgtgtatttatgttataagtaacatatgtaaacatgtatatttgttttatatttatttttgtaacaccagtgtctgatgaaacatttttgcaaatgcattttataaaaaaataaatatagtgataagttaaaaaaaaaattcggccttcgtggcctca

SEQ ID NO: 71740 - DNA, 3843 bp, Homo sapiens
acgtcaccaccagcctagctcggacggcaagcggcgggagattttcaaaatgggagcccagaggcaccgcccaggcctcggaaggtgtcagggagaactttccgtggtttcagcgtcgtcgcctggagcggcggtttagagagccgagcctgatgggcgccaaggccggctggctgcttggagcgctgcctcgaagggactgcgtgaaggaagctaatccggagaacccaggccagagcctggaaatatggcgacctgcatcggggagaagatcgaggattttaaagttggaaatctgcttggtaaaggatcatttgctggtgtctacagagctgagtccattcacactggtttggaagttgcaatcaaaatgatagataagaaagccatgtacaaagcaggaatggtacagagagtccaaaatgaggtgaaaatacattgccaattgaaacatccttctatcttggagctttataactattttgaagatagcaattatgtgtatctggtattagaaatgtgccataatggagaaatgaacaggtatctaaagaatagagtgaaacccttctcagaaaatgaagctcgacacttcatgcaccagatcatcacagggatgttgtatcttcattctcatggtatactacaccgggacctcacactttctaacctcctactgactcgtaatatgaacatcaagattgctgattttgggctggcaactcaactgaaaatgccacatgaaaagcactatacattatgtggaactcctaactacatttcaccagaaattgccactcgaagtgcacatggccttgaatctgatgtttggtccctgggctgtatgttttatacattacttatcgggagaccacccttcgacactgacacagtcaagaacacattaaataaagtagtattggcagattatgaaatgccaacttttttgtcaatagaggccaaggaccttattcaccagttacttcgtagaaatccagcagatcgtttaagtctgtcttcagtattggaccatccttttatgtcccgaaattcttcaacaaaaagtaaagatttaggaactgtggaagactcaattgatagtgggcatgccacaatttctactgcaattacagcttcttccagtaccagtataagtggtagtttatttgacaaaagaagacttttgattggtcagccactcccaaataaaatgactgtatttccaaagaataaaagttcaactgatttttcttcttcaggagatggaaacagtttttatactcagtggggaaatcaagaaaccagtaatagtggaaggggaagagtaattcaagatgcagaagaaaggccacattctcgataccttcgtagagcttattcctctgatagatctggcacttctaatagtcagtctcaagcaaaaacatatacaatggaacgatgtcactcagcagaaatgctttcagtgtccaaaagatcaggaggaggtgaaaatgaagagaggtactcacccacagacaacaatgccaacatttttaacttctttaaagaaaagacatccagtagttctggatcttttgaaagacctgataacaatcaagcactctccaatcatctttgtccaggaaaaactccttttccatttgcagacccgacacctcagactgaaaccgtacaacagtggtttgggaatctgcaaataaatgctcatttaagaaaaactactgaatatgacagcatcagcccaaaccgggacttccagggccatccagatttgcagaaggacacatcaaaaaatgcctggactgatacaaaagtcaaaaagaactctgatgcttctgataatgcacattctgtaaaacagcaaaataccatgaaatatatgactgcacttcacagtaaacctgagataatccaacaagaatgtgtttttggctcagatcctctttctgaacagagcaagactaggggtatggagccaccatggggttatcagaatcgtacattaagaagcattacatctccgttggttgctcacaggttaaaaccaatcagacagaaaaccaaaaaggctgtggtgagcatacttgattcagaggaggtgtgtgtggagcttgtaaaggagtatgcatctcaagaatatgtgaaagaagttcttcagatatctagtgatggaaatacgatcactatttattatccaaatggtggtagaggttttcctcttgctgatagaccaccctcacctactgacaacatcagtaggtacagctttgacaatttaccagaaaaatactggcgaaaatatcaatatgcttccaggtttgtacagcttgtaagatctaaatctcccaaaatcacttattttacaagatatgctaaatgcattttgatggagaattctcctggtgctgattttgaggtttggttttatgatggggtaaaaatacacaaaacagaagatttcattcaggtgattgaaaagacagggaagtcttacactttaaaaagtgaaagtgaagttaatagcttgaaagaggagataaaaatgtatatggaccatgctaatgagggtcatcgtatttgtttagcactggaatccataatttcagaagaggaaaggaaaactaggagtgctccctttttcccaataatcataggaagaaaacctggtagtactagttcacctaaggccttatcacctcctccttctgtggattcaaattacccaacgagagatagagcatctttcaacagaatggtcatgcatagtgctgcttctccaacacaggcaccaatccttaatccctctatggttacaaatgaaggacttggtcttacaactacagcttctggaacagacatctcttctaatagtctaaaagattgtcttcctaaatcagcacaacttttgaaatctgtttttgtgaaaaatgttggttgggctacacagttaactagtggagctgtgtgggttcagtttaatgatgggtcccagttggttgtgcaggcaggagtgtcttctatcagttatacctcaccaaatggtcaaacaactaggtatggagaaaatgaaaaattaccagactacatcaaacagaaattacagtgtctgtcttccatccttttgatgttttctaatccgactcctaattttcattgattaaaactcctttcagacatataagtttaataaataacttttttgttgactttcaagtaaagtgattttttttaatttaacataaagtcttcagaaagcctttctatgaaagaattttaacctataatgtaaaggatgtattctgagagaacaaagcagaatgaaacttgagtcacttactaaatatagtggatataaaatagaacacctgactttgctcttagaccataacccccgaacttactatgttcatatatttgtattgaacaatcttttaaaagcaaaaatgtaaatgatgtgtagtttatttgtgcttttattgttttccctgcgtctcagacatgttgagaatcatggacaaaacctgctggaattttggaatttttgaagatgtaaataatgtgtatttatgttataagtaacatatgtaaacatgtatatttgttttatatttatttttgtaacaccagtgtctgatgaaacatttttgcaaatgcattttataaaaaaataaatatagtgataagttacattatcttttgattcatttaattaaatacttatttttaaataacttaccagtaaactcactttttaaattttgttgcctgttgaggagccaattaaattttaaatattaattttgcaaatgttaaatacattgtttctctattatctgaaaa

SEQ ID NO: 71741 - DNA, 3622 bp, Homo sapiens
acgtcaccaccagcctagctcggacggcaagcggcgggagattttcaaaatgggagcccagaggcaccgcccaggcctcggaaggtgtcagggagaactttccgtggtttcagcgtcgtcgcctggagcggcggtttagagagccgagcctgatgggcgccaaggccggctggctgcttggagcgctgcctcgaagggactgcgtgaaggaagctaatccggagaacccaggccagagcctggaaatatggcgacctgcatcggggagaagatcgaggattttaaagttggaaatctgcttggtaaaggatcatttgctggtgtctacagagctgagtccattcacactggtttggaagttgcaatcaaaatgctttataactattttgaagatagcaattatgtgtatctggtattagaaatgtgccataatggagaaatgaacaggtatctaaagaatagagtgaaacccttctcagaaaatgaagctcgacacttcatgcaccagatcatcacagggatgttgtatcttcattctcatggtatactacaccgggacctcacactttctaacctcctactgactcgtaatatgaacatcaagattgctgattttgggctggcaactcaactgaaaatgccacatgaaaagcactatacattatgtggaactcctaactacatttcaccagaaattgccactcgaagtgcacatggccttgaatctgatgtttggtccctgggctgtatgttttatacattacttatcgggagaccacccttcgacactgacacagtcaagaacacattaaataaagtagtattggcagattatgaaatgccaacttttttgtcaatagaggccaaggaccttattcaccagttacttcgtagaaatccagcagatcgtttaagtctgtcttcagtattggaccatccttttatgtcccgaaattcttcaacaaaaagtaaagatttaggaactgtggaagactcaattgatagtgggcatgccacaatttctactgcaattacagcttcttccagtaccagtataagtggtagtttatttgacaaaagaagacttttgattggtcagccactcccaaataaaatgactgtatttccaaagaataaaagttcaactgatttttcttcttcaggagatggaaacagtttttatactcagtggggaaatcaagaaaccagtaatagtggaaggggaagagtaattcaagatgcagaagaaaggccacattctcgataccttcgtagagcttattcctctgatagatctggcacttctaatagtcagtctcaagcaaaaacatatacaatggaacgatgtcactcagcagaaatgctttcagtgtccaaaagatcaggaggaggtgaaaatgaagagaggtactcacccacagacaacaatgccaacatttttaacttctttaaagaaaagacatccagtagttctggatcttttgaaagacctgataacaatcaagcactctccaatcatctttgtccaggaaaaactccttttccatttgcagacccgacacctcagactgaaaccgtacaacagtggtttgggaatctgcaaataaatgctcatttaagaaaaactactgaatatgacagcatcagcccaaaccgggacttccagggccatccagatttgcagaaggacacatcaaaaaatgcctggactgatacaaaagtcaaaaagaactctgatgcttctgataatgcacattctgtaaaacagcaaaataccatgaaatatatgactgcacttcacagtaaacctgagataatccaacaagaatgtgtttttggctcagatcctctttctgaacagagcaagactaggggtatggagccaccatggggttatcagaatcgtacattaagaagcattacatctccgttggttgctcacaggttaaaaccaatcagacagaaaaccaaaaaggctgtggtgagcatacttgattcagaggaggtgtgtgtggagcttgtaaaggagtatgcatctcaagaatatgtgaaagaagttcttcagatatctagtgatggaaatacgatcactatttattatccaaatggtggtagaggttttcctcttgctgatagaccaccctcacctactgacaacatcagtaggtacagctttgacaatttaccagaaaaatactggcgaaaatatcaatatgcttccaggtttgtacagcttgtaagatctaaatctcccaaaatcacttattttacaagatatgctaaatgcattttgatggagaattctcctggtgctgattttgaggtttggttttatgatggggtaaaaatacacaaaacagaagatttcattcaggtgattgaaaagacagggaagtcttacactttaaaaagtgaaagtgaagttaatagcttgaaagaggagataaaaatgtatatggaccatgctaatgagggtcatcgtatttgtttagcactggaatccataatttcagaagaggaaaggaaaactaggagtgctccctttttcccaataatcataggaagaaaacctggtagtactagttcacctaaggccttatcacctcctccttctgtggattcaaattacccaacgagagatagagcatctttcaacagaatggtcatgcatagtgctgcttctccaacacaggcaccaatccttaatccctctatggttacaaatgaaggacttggtcttacaactacagcttctggaacagacatctcttctaatagtctaaaagattgtcttcctaaatcagcacaacttttgaaatctgtttttgtgaaaaatgttggttgggctacacagttaactagtggagctgtgtgggttcagtttaatgatgggtcccagttggttgtgcaggcaggagtgtcttctatcagttatacctcaccaaatggtcaaacaactaggtatggagaaaatgaaaaattaccagactacatcaaacagaaattacagtgtctgtcttccatccttttgatgttttctaatccgactcctaattttcattgattaaaactcctttcagacatataagtttaataaataacttttttgttgactttcaagtaaagtgattttttttaatttaacataaagtcttcagaaagcctttctatgaaagaattttaacctataatgtaaaggatgtattctgagagaacaaagcagaatgaaacttgagtcacttactaaatatagtggatataaaatagaacacctgactttgctcttagaccataacccccgaacttactatgttcatatatttgtattgaacaatcttttaaaagcaaaaatgtaaatgatgtgtagtttatttgtgcttttattgttttccctgcgtctcagacatgttgagaatcatggacaaaacctgctggaattttggaatttttgaagatgtaaataatgtgtatttatgttataagtaacatatgtaaacatgtatatttgttttatatttatttttgtaacaccagtgtctgatgaaacatttttgcaaatgcattttataaaaaaataaatatagtgataagttaaaaaaaaaattcggccttcgtggcctca

SEQ ID NO: 71742 - DNA, 2627 bp, Homo sapiens
acgtcaccaccagcctagctcggacggcaagcggcgggagattttcaaaatgggagcccagaggcaccgcccaggcctcggaaggtgtcagggagaactttccgtggtttcagcgtcgtcgcctggagcggcggtttagagagccgagcctgatgggcgccaaggccggctggctgcttggagcgctgcctcgaagggactgcgtgaaggaagctaatccggagaacccaggccagagcctggaaatatggcgacctgcatcggggagaagatcgaggattttaaagttggaaatctgcttggtaaaggatcatttgctggtgtctacagagctgagtccattcacactggtttggaagttgcaatcaaaatgatagataagaaagccatgtacaaagcaggaatggtacagagagtccaaaatgaggtgaaaatacattgccaattgaaacatccttctatcttggagctttataactattttgaagatagcaattatgtgtatctggtattagaaatgtgccataatggagaaatgaacaggtatctaaagaatagagtgaaacccttctcagaaaatgaagctcgacacttcatgcaccagatcatcacagggatgttgtatcttcattctcatggtatactacaccgggacctcacactttctaacctcctactgactcgtaatatgaacatcaagattgctgattttgggctggcaactcaactgaaaatgccacatgaaaagcactatacattatgtggaactcctaactacatttcaccagaaattgccactcgaagtgcacatggccttgaatctgatgtttggtccctgggctgtatgttttatacattacttatcgggagaccacccttcgacactgacacagtcaagaacacattaaataaagtagtattggcagattatgaaatgccaacttttttgtcaatagaggccaaggaccttattcaccagttacttcgtagaaatccagcagatcgtttaagtctgtcttcagtattggaccatccttttatgtcccgaaattcttcaacaaaaagtaaagatttaggaactgtggaagactcaattgatagtgggcatgccacaatttctactgcaattacagcttcttccagtaccagtataagtggtagtttatttgacaaaagaagacttttgattggtcagccactcccaaataaaatgactgtatttccaaagaataaaagttcaactgatttttcttcttcaggagatggaaacagtttttatactcagtggggaaatcaagaaaccagtaatagtggaaggggaagagtaattcaagatgcagaagaaaggccacattctcgataccttcgtagagcttattcctctgatagatctggcacttctaatagtcagtctcaagcaaaaacatatacaatggaacgatgtcactcagcagaaatgctttcagtgtccaaaagatcaggaggaggtgaaaatgaagagaggtactcacccacagacaacaatgccaacatttttaacttctttaaagaaaagacatccagtagttctggatcttttgaaagacctgataacaatcaagcactctccaatcatctttgtccaggaaaaactccttttccatttgcagacccgacacctcagactgaaaccgtacaacagtggtttgggaatctgcaaataaatgctcatttaagaaaaactactgaatatgacagcatcagcccaaaccgggacttccagggccatccagatttgcagaaggacacatcaaaaaatgcctggactgatacaaaagtcaaaaagaactctgatgcttctgataatgcacattctgtaaaacagcaaaataccatgaaatatatgactgcacttcacagtaaacctgagataatccaacaagaatgtgtttttggctcagatcctctttctgaacagagcaagactaggggtatggagccaccatggggttatcagaatcgtacattaagaagcattacatctccgttggttgctcacaggttaaaaccaatcagacagaaaaccaaaaaggctgtggtgagcatacttgattcagaggaggtgtgtgtggagcttgtaaaggagtatgcatctcaagaatatgtgaaagaagttcttcagatatctagtgatggaaatacgatcactatttattatccaaatggtggtagaggttttcctcttgctgatagaccaccctcacctactgacaacatcagtaggtacagctttgacaatttaccagaaaaatactggcgaaaatatcaatatgcttccaggtttgtacagcttgtaagatctaaatctcccaaaatcacttattttacaagatatgctaaatgcattttgatggagaattctcctggtgctgattttgaggtttggttttatgatggtaagtaccatttggaaatggtaatttgttcctttagtttgtaatttagtagttacgtatatgtgggtttttaaaattcaacacagtcagttttaaagatgtgtatgtatataactatacatataaattgcacagcggagtatacatgtcaaatcatattaatcaaaatttatctagccttcctttaaacaa

SEQ ID NO: 71743 - DNA, 213 bp, Homo sapiens
gaaacttgttttaaaacagattcaaggtaagcttaaaataatagaatagagaccacttcagataaatacatttcacccagtaaatttaaccagagcagagttttaattccttttaaatgaaaatgttttaagatatatgaaggaaaagaatagatacatttaataagaagagacatcactcagtcagccaagaattgtcaatgaagacttaaa

SEQ ID NO: 71744 - DNA, 468 bp, Homo sapiens
gccctgcagccggtgtaccatggtgatgttgccagagtgcaaatggtgttttggaagggctgtcgggagtgattcccggcactgcatgctgactaaaaaggccgtccatggcttctcttcctgacatccacctaactgctgtggcctcatcaggtttgcctctgaattactaagactgtgctttctgggagttgaaactattgatcacattaagaatttaagattcttgctggagcaacattctcctttgtgtggaaagtcctgaatttttatcttagactttaggaatcactggcaacttataaaatgatagaaactaagggttcaaaagaacccttagcttcttttgaaatgaccacatttttcagaaggggaaactgaggcatggggcggcttggactcgcttcaggccacacagcaattcagtggaaaagaatggagcagaacctggtctgtacttctacgtag

SEQ ID NO: 71745 - DNA, 438 bp, Homo sapiens
gtccacctattattttctgttcactgccaccaattcatagagtgcatcaattttctttcatttttgtttctcaactcctacggcaaagtttagcactataaaatatgtgacatgacttgaggatgaagcagcagctccctgctgaaacttcagagcaagaagcagtttttttttttttagaaagtcaatgagctaccagctgtttgcctaaaaaagatatggcagcattagccacgcagatattctgcagttgttccctggccataatgataaaaaaatttttaagactcaactgcatatgtcttccaggaagtggccacagataccaagctgttactaacaatgaccagtaaggagacatgttaactttgtaatggataagctgtgtcaagatgccatattcaggcattgtcaaggtcactttttattttgtgattc

SEQ ID NO: 71746 - DNA, 743 bp, Homo sapiens
aggaaagtaggtttgaaataggaatgatgagacctttaaagaatgaataccaaaaaattaatttcagataattataaaaataagaactacaagagtgaaatataaggtagagagataaaaaaaattaatgaacaaagaaatttacataaagaatatggttattagaaacagccccaatgggggatggtgttaaaccatggagaagctactcccatgatccaatcaccccccatcaggccccatttccagcttgaggattacaatttgacatgagatttgggtggggacacagatccaaaccgtatcacttacatttcttacctctaaactatttctgtgccaaggttctatatctcattgaatgacagacaccacaagttgcccaagccagaaagctgggtgaagtacttaacttcttccctcaccacaattgcctacatatagtcagtcaattaccagattctattaaatctatctctgatgtaggtcctgattctgtctacttgtctccatcttcattgccactgtcctgttccaggtacctctggctgtttgcaacagacttcaaactggccattctgtgtcctgacttgtttctctaatccattctctatacaaccaccaaagcaatttttataaaacacaaactgatcatgttatttccctgaattaaaacatttcagtggtttgtacattatacctccgcctaaaagctcaaatttcttaacatggccatacacctt

SEQ ID NO: 71747 - DNA, 702 bp, Homo sapiens
gatgttccaagattctttcatcatacccttctgttttcagaatgtcttttgttatctttctagggtaagtctgctggtgacatactctcttcattttccttcatatgtcttgatttccctttcattccagaagggtgttttctctagatacaggtttctgagttgacagtccttttctttcagcacttgaaaaatgtgaaatttccttctgattagaaacctgctatcatttgaactgttttccacatctacatgaagtgtaatttctctcgtgctgatttcaagacttgtcttgtttttataagttttactttgagatatcctggtctggatgtctacaggtttatcctgttgaacattcacttggctttttaaaactgtagcttaatgtcttttgccaaattcgcaaaattttcagccattatttccttaagtactttttcaatcctgccctctctcttcctctccttctgtgactctaacgacacaagtgttaaatctttttatagactcatggttccctgaggctctgcacattttttttttcagtctgtttactgttgttcagactgggtaactacttctgcctgctagttcactgatctttcctcagtctggtctatttgctattaagcctactcactgggctactgtattgtttattatatttttcagttctaaaattactatttggtctttctt

SEQ ID NO: 71748 - DNA, 303 bp, Homo sapiens
atagcagtgtgagaatagactaatatactgctcctagatgtgtacctaatagacatgaaaacttgtgtccatcaaaatacgtattaaagaatgctcatgcaatagtcctggtttaccctagggggataatgtgcccaggccatgcttgaaaccatggatggtactctatatatataccattttttcatatatatatatatctccatacctatgataaagcttaatttacaaattaacacagtaagagattaataaaatagaacaattataaaaacatactgcaataaaatttatgtgaatctg

SEQ ID NO: 71749 - DNA, 340 bp, Homo sapiens
tgtatttttagtagagaaggggtttcgccaagttggccaggctggtctcgaactcctgatctcaggagatcggcctgcctcggcctcccaaaatgctgggattataggcgtgacactgtctctggtttaagagaaccatgggctgagatattgaggaattctccaggccacgaatcttggggcatgcagcctcttccgtaccccacagcatctgggggagctggtgtgctgatggggtcagctctcccagctgcctggaaattctcagacactccctaagaggacatctccacccctcccactctgacgtcactgctttctaacattgctcatttgtttg

SEQ ID NO: 71750 - DNA, 273 bp, Homo sapiens
aattttatgtcaccttttctcattcattaattgttatagccatagccaaaggatctgaaaacataggaccactaatgactgcaaaatgaaatcctgattattgtttttaaatttttagtatgtttaatacacatatgctaacattactgaacagttaaatgataaaataggataattattttattctaaaaaagtattgaccttgacctctttctagctatcttagaaagggcttttgtcaaaaacctccatctcaaaacaaacaaacaaaca

SEQ ID NO: 71751 - DNA, 266 bp, Homo sapiens
tgaagctgcgtcgacgcagtaatgtcaacataatgaaccatcttaattcagcctggcagaggtcacaacagctctagttttcaccttcatggtgaaggatgatcgtgttgttggaataaatagacctggacttgattacaagtgacatttgaaagtgttgattcagattgtcccgtcgcttcaaaatggagccctagtctttaagcacagtggtgagataagtattattaatgacaggcattagttaggataaaggcaaaaaaaaa

SEQ ID NO: 71752 - DNA, 583 bp, Homo sapiens
agataagaagacagacgtttatgaagttctagtgacttacccagtgaggtcaaactctggcaaggtaacgggccttatacttgagtggaggtgatctgactccaggaattcgggttgtgaaccattccatgaggattcctggtcatctcccatcatattcatccccctattccttcagggcctcctcctcatgttctgcctcctcagaccactagcacatcgcctccctgacctcttctagcccttgttcccagagtggactgctgtttacttagaacagaggcacctgggggacttgttcaaattgcatattcctggatctgcaaaatcagaagtctcaaggattagagtctaggaaggggcattttaaaccagctccctaggtaattttgatacacaccgaagttgggaagggctctttagagcaatcgacttaatgccacacaaaaaagcacttgcttatttgtttcccaattattttctgggtcaatgtgattctctaaaagaagagaactctctatggccttctgtagcactcaggttagcattaggcaaaaaaaggattccagggaaggcctactgg

SEQ ID NO: 71753 - DNA, 456 bp, Homo sapiens
atttttcttgaaaatattgtcaaaactctaatatgaaattttgaaattaattaggcaaaaagaaattactgtggtgtaattctgagctttccagtcagtacacagaataagttatggctattccaagataacgttttcctccttttttggatggctgggagagtgtaaggggatttagaacctcagggctgcccagtccagccccagcttcctgaaccatgtaaatattaaaaatttctacttgtgaacactgcttaagtgtggctataattaattgaggtcatcaaatgtgctgaaattgtatccaaaggatgctgtgtggtgagaaatttgggtttttttttcccatgtgaaagcatattctagtatctttttttattggggagaacatagaatttataaaatatataaccattatttgcgggtcagtaggtaccttttgtcccctatgtgttc

SEQ ID NO: 71754 - DNA, 2502 bp, Homo sapiens
aggcgtcgggcgaccgagcgcgcgggaagggcgagcgctatacgccgcgcggctgcctcgccctctctcctggtgatagccatttggcgtcttctgtctgctctcggtgcctggcgaagcccgagttggccctgaggcgtctgcacggggaggcgagggcgagcatgtttgttgtttaccaagaattggaaaaataagggcccggactcttcggactctctgtacggtattggggtgtgggagccacctcctcccctgaaggtcccaggatactcgctgcccgcaccctgcgggctcggccggacattcctcggaaacagctgcgtctgtgtgagaaatgagcggattacctgaggcgtggaggggtttagagacagcattttgccagtccacgacactgaagcggggcaaacgtgggaactccttactgccagaaaggtgagggaatgaggagatgcagcaagcctgctgaaaaggcggcagacatgctgcggggccagcagccacgggaccagcagccacgcagtctgccttcgcagcgtagcttcattcattcatgcgcgtagcaaataagtattcaatgctcaccctatgccattgttctgggcgtcaatgaagggagtataaacagcacctgctcccatggatttggaaggaatctttgctacaatagctaatgaagattgacttgtgcttcctcaagctactctataacttgtatgcccattgattttaattgcatttaagattctgcagtgcacttagtggatgtgcaaacgttttaaacataaaatagaggtcacagcctattgacctctgttcccgtttgcttctttggaaaagtttttagttttgttgctatcttgggatcaaaaatagtgtcccctcttttcttaatgtgcttataaattaatataagttcccttttattgattttccatttcaaacataaatgttaaccaacaagtaacagtttacacatagatgtctgtatgctgctctttctagtcacatccatttagctataacatgatgaagtctaattaattgaagcttcaataaatggaaggaccagcttaaagtaaaataagcctgtgaaaaatcttggcacaattgaaatttcataaatatctgtgaaagataattaggcatcttaaagtgaaaagtcttcattatgaacttattaatgaagatggatgtttttgaagtttgaaagaattcttgtcttaaggtaggggtgtccccaaggagagggtaaattattacctgtcaaaggatatgacaagaaagtacttactggtgaattttctgtgttcgaaagcctggctctgtagaactagaaattggtattgtaagcccaacagtgggttcattttttagagtagtctcaaatttataaatctcaaaaaaaaggaactgtgtaaactagaataacaatttactgattttcaagtaagaaatacgacatgcatttaattcaaactcatgcaaatatttatgaagcacctatgtccaggacactgtgctatgtgttgaaaatttggagttcaaatttatcaagaaagatatatattgaaaaagtaaaagtaggatgggtgttaagaaagaggaagtatgggagcttgtagaagcacgcacgaggtttataacctaggttagatggtcaggaagatctccaaaatgattttatcttaagggaatgagaaattattaaaaaggctttaaataggaaattagcatgatcagatttgtcggctagaatatttgtgtaatcggaaagggtaatgtttcaagaagtgtattaatgtcactttctgggtatacaacttaatcaatccaaggcacctttctgctgaggatttggattcttgtataaaaaatacaaaagaaatatttactttttaactttcgatattaaatataggattttttaaatcgagtttttaggcttcaaatcgaggcattgtcaagacataaaatgtaaatttgtttatggttcaacatatcaaggctaggcctggtggaccaaatgatagggtttctcccatagtaaagacaaggtatcttagtccagtatgaaggatttagtcagagattgatataaggaaggtggtggctatgaagtaggtaaagtagaagaaaatcctattctctttggcttggagaattacgggaaaggggtagaagagctcaagaaagacaccagaaacatttttactgttcccaccctgaagatgtagggtgaggggttgtggctttagaaatatccagattggtgtgggaaaactcaaggacagagaaattactttcccaattctcagatatctgggaagatatcaggctgagcaggaaccacattccagtaaccttgaacagggcggagacagggtaggcattgactttccagagtgctgtaagtttctatgtactgttgagactcagaaaacaatactcccctcctccaccaaaaaaaaaaaaaaaaaaaaaaaaaaaaaaaaaaaa

SEQ ID NO: 71755 - DNA, 2111 bp, Homo sapiens
aggcgtcgggcgaccgagcgcgcgggaagggcgagcgctatacgccgcgcggctgcctcgccctctctcctggtgatagccatttggcgtcttctgtctgctctcggtgcctggcgaagcccgagttggccctgaggcgtctgcacggggaggcgagggcgagcatgtttgttgtttaccaagaattggaaaaataagggcccggactcttcggactctctgtacggtattggggtgtgggagccacctcctcccctgaaggtcccaggatactcgctgcccgcaccctgcgggctcggccggacattcctcggaaacagctgcgtctgtgtgagaaatgagcggattacctgaggcgtggaggggtttagagacagcattttgccagtccacgacactgaagcggggcaaacgtgggaactccttactgccagaaaggtgagggaatgaggagatgcagcaagcctgctgaaaaggcggcagacatgctgcggggccagcagccacgggaccagcagccacgcagtctgccttcgcagcgtagcttcattcattcatgcgcgtagcaaataagtattcaatgctcaccctatgccattgttctgggcgtcaatgaagggagtataaacagcacctgctcccatggatttggaaggaatctttgctacaatagctaatgaagattgacttgtgcttcctcaagctactctataacttgtatgcccattgattttaattgcatttaagattctgcagtgcacttagtggatgtgcaaacgttttaaacataaaatagaggtcacagcctattgacctctgttcccgtttgcttctttggaaaagtttttagttttgttgctatcttgggatcaaaaatagtgtcccctcttttcttaatgtgcttataaattaatataagttcccttttattgattttccatttcaaacataaatgttaaccaacaagtaacagtttacacatagatgtctgtatgctgctctttctagtcacatccatttagctataacatgatgaagtctaattaattgaagcttcaataaatggaaggaccagcttaaagtaaaataagcctgtgaaaaatcttggcacaattgaaatttcataaatatctgtgaaagataattaggcatcttaaagtgaaaagtcttcattatgaacttattaatgaagatggatgtttttgaagtttgaaagaattcttgtcttaaggtaggggtgtccccaaggagagggtaaattattacctgtcaaaggatatgacaagaaagtacttactggtgaattttctgtgttcgaaagcctggctctgtagaactagaaattggtattgtaagcccaacagtgggttcattttttagagtagtctcaaatttataaatctcaaaaaaaaggaactgtgtaaactagaataacaatttactgattttcaagtaagaaatacgacatgcatttaattcaaactcatgcaaatatttatgaagcacctatgtccaggacactgtgctatgtgttgaaaatttggagttcaaatttatcaagaaagatatatattgaaaaagtaaaagtaggatgggtgttaagaaagaggaagtatgggagcttgtagaagcacgcacgaggtttataacctaggttagatggtcaggaagatctccaaaatgattttatcttaagggaatgagaaattattaaaaaggctttaaataggaaattagcatgatcagatttgtcggctagaatatttgtgtaatcggaaagggtaatgtttcaagaagtgtattaatgtcactttctgggtatacaacttaatcaatccaaggcacctttctgctgaggatttggattcttgtataaaaaatacaaaagaaatatttactttttaactttcgatattaaatataggattttttaaatcgagtttttaggcttcaaatcgaggcattgtcaagacataaaatgtaaatttgtttatggttcaacatatcaaggctaggcctggtggaccaaatgagccttagtcgccaaggttctactgaagcagctgacccatctgcagctctattccagaccccacttatctcccagcacc

SEQ ID NO: 71756 - DNA, 2281 bp, Homo sapiens
  misc_feature (1143)..(1143): n is a, c, g, or t
  misc_feature (1173)..(1173): n is a, c, g, or t
  misc_feature (1435)..(1435): n is a, c, g, or t
gttgcctaggtagtcacaagagatcagagggagtcactgtcttttccatgctgagcactcatgtgcccctccctgccctcggtcacatattggaagagtggaagaggcagccactgtggttctaactctgcggctttatctttttggactgtctgaaactcttattcagcatgagttttactgtctcttgtttctgtcactgagggaggtggcatgccatccagcccttcctggcatccagtggctctctcatactgcttgatgtggcttgtctgggagccatggggtttcttctgcctacctaagtaggaaagcttctggccacactatgtccacttgacatgaaggatttccctagataaggccttcccaacctgtgtttacagggacttaacacaaaaacatgtgaaagtaattattctgtgagaaaaaaatatctcttgaaagagtaacttttccgctgcattttgttagctggtgagactgcaaggtatctgaaccgtgtgccctggtacccacccctgtctctggacttctttatgaacactgagtatttgactccccacccttcatggtcagctccttttaacaccctagatatcattgctgtccttttcattgacatgctagagacatttccaattttcatgggagtcagtaagatagagatgatgaaaattcagagtgttcaaagaaagaggaggcctcatcagttgatagaatatacaacagattgtctaatctcagttttcttcacttttctacccattacagtggaaaaaagaacccttaaggaagccagtgcttctcaacattggttacaaaaccatcagtgccagcacttaatttaaaatcttctgaaaatccatcagttggttttcatgtctcactctaaactcagctccaaccaggctgcttcctagattcttgtctgtgtgtgtttctgttttggctctttgttacttccttctgtaaacttaagtaaactcagtttgttgacctagtgaattgattctttccattttctatactattcaccagcatatcaaagatgcttcttcctaactctgatttccagagtaactgtgctatcagcttttcatactaagaactaggtttttaccttttcacatttcttgcctnctacccagttcgtaagccaaattagactcntactcttgtgaagtgccctttagatactagtgtaaaatatactgcgtaattctccattgccctacatatattaaccctttaagaaaatatatcaccagtctattttatcttcgcagaacttgcccaggtatgagccagcatttattaccactcattctagaaggtgccagttaggtagctatccaggtttacattttaaggcagtcgagaccttattcacgtggtatataaacaaccacatttctcttttatatggaacaanacttttcatttgcggctggccttctcactagcttatgctttttttttttaagacctttcttagcactcgctgaactcctccccctcacaatcaatctcagcaactcagcagagtcgcttcagttcacagctcttaatccttcactccagactaaagctaatcttatgtcctcaaacagctacaactcactgttatcacagttccgactgcagagactccatttaagaggaaatttaaaaaataaacaatgctctatttctgtccacatcaaaggtacctctaacagaaacttgtctttgcttctgtctctctgctactggactctcagctcaaggtaatgtaagatgatctcatagatgcactttagcctcttgatgttagcagttgagtcctccctgcgcacaaaatacatttgtggtaatgaatgcccagaatctcactggcacacccaagagtagttaaactaaaattgctactaacacaacattgtagaattcgttgccttaatggatgtgatcttctaggcttactgtgtcttaacaagcagtcttatatatatttatcttgcccagaaagtacacttgtagaatttaacatttgctcctttctccaaacagattaaaggttatgcagctgattgattctgtgtcccattttaaaggtccaggctatcccctagatttagattagttcctaaaaaatcttccagtctgaatcctgacaaatggatagctaaattaatttccactcctcttctctcttgcactgtttggtacattacagccaccattagccttaaaagctgcagcagccaaattcggtgacagtaacataaagcctgagctt

SEQ ID NO: 71757 - DNA, 1464 bp, Homo sapiens
aggcgagctcagcccgcgacctttatcccgcgcgttgcggtcaagatggcgctggtggcttctgtgcgagtcccggcgcgcgttctgctccgcgcgggggcccggctcccgggcgcggccctcgggcggacggagcgggcggccggcggcggagacggcgcgcggcgcttcgggagccagcgggtgctggtggagccggacgcgggcgcaggggtcgctgtgatgaaattcaagaaccccccagtgaacagcctgagcctggagtttctgacggagctggtcatcagcctggagaagctggagaatgacaagagcttccgcggtgtcattctgacctcggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacggagcctgccccgctggaggctgcctggtggccctgacctgtgactaccgcatcctggcggacaaccccaggtactgcataggactcaatgagacccagctgggcatcatcgcccctttctggttgaaagacaccctggagaacaccatcgggcaccgggcggcggagcgtgccctgcagctggggctgctcttcccgccggcggaggccctgcaggtgggcatagtggaccaggtggtcccggaggagcaggtgcagagcactgcgctgtcagcgatagcccagtggatggccattccagaccatgctcgacagctgaccaaggccatgatgcgaaaggccacggccagccgcctggtcacgcagcgcgatgcggacgtgcagaacttcgtcagcttcatctccaaagactccatccagaagtccctgcagatgtacttagagaggctcaaagaagaaaaaggctaacgattgggctgccacaggcttacggccacacgtgcccctgtgggtcccagggaggtcttaaacaaggtatttttcaacttaaaagtactgccagcgtttcattttgctgatgttacgtagaagttcctgttcctcatagcccagtggcccaaggcccagccacacacaaacacacatgggtgcctgtgcccgtcaggcaaggggagttggagggcagccttttgacttgggattgtgactggcaggggatgccattctggacctggtgaggttgccacggagtgtctctgttcccaaggcagaatcgtaagtcaagtccctggtcatccattctggcctttggactgcctgctcttaggtgtaaggccaggtggtcttggcccccatgacccacacagaactccccagggaaaagccctttggtcactgcccttactcatcaggatgaagagcgcacagtgaatcagagcaactgggggatcctgagccagcgggagtgggactctggag

SEQ ID NO: 71758 - DNA, 1424 bp, Homo sapiens
aggcgagctcagcccgcgacctttatcccgcgcgttgcggtcaagatggcgctggtggcttctgtgcgagtcccggcgcgcgttctgctccgcgcgggggcccggctcccgggcgcggccctcgggcggacggagcgggcggccggcggcggagacggcgcgcggcgcttcgggagccagcgggtgctggtggagccggacgcgggcgcaggggtcgctgtgatgaaattcaagaaccccccagtgaacagcctgagcctggagtttctgacggagctggtcatcagcctggagaagctggagaatgacaagagcttccgcggtgtcattctgacctcggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacggagcctgccccgctggaggctgcctggtggccctgacctgtgactaccgcatcctggcggacaaccccaggtactgcataggactcaatgagacccagctgggcatcatcgcccctttctggttgaaagacaccctggagaacaccatcgggcaccgggcggcggagcgtgccctgcagctggggctgctcttcccgccggcggaggccctgcaggtgggcatagtggaccaggtggtcccggaggagcaggtgcagagcactgcgctgtcagcgatagcccagtggatggccattccagaccatgctcgacagctgaccaaggccatgatgcgaaaggccacggccagccgcctggtcacgcagcgcgatgcggacgtgcagaacttcgtcagcttcatctccaaagactccatccagaagtccctgcagatgtacttagagaggctcaaagaagaaaaaggctaacgattgggctgccacaggcttacggccacacgtgcccctgtgggtcccagggaggtcttaaacaaggtatttttcaacttaaaaaaaaaaaaaaaaaaaaaacaaaaatttggttgggccgggccttgggccccttgaaaaagtttttataaaccttcgcgtttggggcgccgcgggccccgttgggttagtgttgaccgtgtggccaagagctgtgtttccctaaggggaagaccccgtgggctcatggagcctataggtcgttgggggtttctcttccacacaatataaaaaaacacgcgccgggggggcgaaacccgggaacgcggtcttcgtggaaacaaattctcccagagatgggagagtgtcctgaggagggtccattaatgggggagtctcttattcacacggggggaggctccaggcggacgcctggattattcaaattatagcccccggcccgggggtgt

SEQ ID NO: 71759 - DNA, 1477 bp, Homo sapiens
gcgcggagcattattgggtaccttaagtgccaaagagtatgctgtcgtcgaatccgggatggcgctggtggcttctgtgcgagtcccggcgcgcgttctgctccgcgcgggggcccggctcccgggcgcggccctcgggcggacggagcgggcggccggcggcggagacggcgcgcggcgcttcgggagccagcgggtgctggtggagccggacgcgggcgcaggggtcgctgtgatgaaattcaagaaccccccagtgaacagcctgagcctggagtttctgacggagctggtcatcagcctggagaagctggagaatgacaagagcttccgcggtgtcattctgacctcggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacggagcctgccccgctggaggctgcctggtggccctgacctgtgactaccgcatcctggcggacaaccccaggtactgcataggactcaatgagacccagctgggcatcatcgcccctttctggttgaaagacaccctggagaacaccatcgggcaccgggcggcggagcgtgccctgcagctggggctgctcttcccgccggcggaggccctgcaggtgggcatagtggaccaggtggtcccggaggagcaggtgcagagcactgcgctgtcagcgatagcccagtggatggccattccagaccatgctcgacagctgaccaaggccatgatgcgaaaggccacggccagccgcctggtcacgcagcgcgatgcggacgtgcagaacttcgtcagcttcatctccaaagactccatccagaagtccctgcagatgtacttagagaggctcaaagaagaaaaaggctaacgattgggctgccacaggcttacggccacacgtgcccctgtgggtcccagggaggtcttaaacaaggtatttttcaacttaaaagtactgccagcgtttcattttgctgatgttacgtagaagttcctgttcctcatagcccagtggcccaaggcccagccacacacaaacacacatgggtgcctgtgcccgtcaggcaaggggagttggagggcagccttttgacttgggattgtgactggcaggggatgccattctggacctggtgaggttgccacggagtgtctctgttcccaaggcagaatcgtaagtcaagtccctggtcatccattctggcctttggactgcctgctcttaggtgtaaggccaggtggtcttggcccccatgacccacacagaactccccagggaaaagccctttggtcactgcccttactcatcaggatgaagagcgcacagtgaatcagagcaactgggggatcctgagccagcgggagtgggactctggag

SEQ ID NO: 71760 - DNA, 1560 bp, Homo sapiens
gcgcggagcattattgggtaccttaagtgccaaagagtatgctgtcgtcgaatccgggatggcgctggtggcttctgtgcgagtcccggcgcgcgttctgctccgcgcgggcgaaacccggggtgggcagggatcgggccggggccggggccaggaccgggaactaacgggctcccccacgctgccttcgcaggggcccggctcccgggcgcggccctcgggcggacggagcgggcggccggcggcggagacggcgcgcggcgcttcgggagccagcgggtgctggtggagccggacgcgggcgcaggggtcgctgtgatgaaattcaagaaccccccagtgaacagcctgagcctggagtttctgacggagctggtcatcagcctggagaagctggagaatgacaagagcttccgcggtgtcattctgacctcggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacggagcctgccccgctggaggctgcctggtggccctgacctgtgactaccgcatcctggcggacaaccccaggtactgcataggactcaatgagacccagctgggcatcatcgcccctttctggttgaaagacaccctggagaacaccatcgggcaccgggcggcggagcgtgccctgcagctggggctgctcttcccgccggcggaggccctgcaggtgggcatagtggaccaggtggtcccggaggagcaggtgcagagcactgcgctgtcagcgatagcccagtggatggccattccagaccatgctcgacagctgaccaaggccatgatgcgaaaggccacggccagccgcctggtcacgcagcgcgatgcggacgtgcagaacttcgtcagcttcatctccaaagactccatccagaagtccctgcagatgtacttagagaggctcaaagaagaaaaaggctaacgattgggctgccacaggcttacggccacacgtgcccctgtgggtcccagggaggtcttaaacaaggtatttttcaacttaaaagtactgccagcgtttcattttgctgatgttacgtagaagttcctgttcctcatagcccagtggcccaaggcccagccacacacaaacacacatgggtgcctgtgcccgtcaggcaaggggagttggagggcagccttttgacttgggattgtgactggcaggggatgccattctggacctggtgaggttgccacggagtgtctctgttcccaaggcagaatcgtaagtcaagtccctggtcatccattctggcctttggactgcctgctcttaggtgtaaggccaggtggtcttggcccccatgacccacacagaactccccagggaaaagccctttggtcactgcccttactcatcaggatgaagagcgcacagtgaatcagagcaactgggggatcctgagccagcgggagtgggactctggag

SEQ ID NO: 71761 - DNA, 1429 bp, Homo sapiens
agcggggtagcgcgcggctgcccggggtgaagccggagggcggcgagcggctgtttcggccggggcccggctcccgggcgcggccctcgggcggacggagcgggcggccggcggcggagacggcgcgcggcgcttcgggagccagcgggtgctggtggagccggacgcgggcgcaggggtcgctgtgatgaaattcaagaaccccccagtgaacagcctgagcctggagtttctgacggagctggtcatcagcctggagaagctggagaatgacaagagcttccgcggtgtcattctgacctcggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacggagcctgccccgctggaggctgcctggtggccctgacctgtgactaccgcatcctggcggacaaccccaggtactgcataggactcaatgagacccagctgggcatcatcgcccctttctggttgaaagacaccctggagaacaccatcgggcaccgggcggcggagcgtgccctgcagctggggctgctcttcccgccggcggaggccctgcaggtgggcatagtggaccaggtggtcccggaggagcaggtgcagagcactgcgctgtcagcgatagcccagtggatggccattccagaccatgctcgacagctgaccaaggccatgatgcgaaaggccacggccagccgcctggtcacgcagcgcgatgcggacgtgcagaacttcgtcagcttcatctccaaagactccatccagaagtccctgcagatgtacttagagaggctcaaagaagaaaaaggctaacgattgggctgccacaggcttacggccacacgtgcccctgtgggtcccagggaggtcttaaacaaggtatttttcaacttaaaagtactgccagcgtttcattttgctgatgttacgtagaagttcctgttcctcatagcccagtggcccaaggcccagccacacacaaacacacatgggtgcctgtgcccgtcaggcaaggggagttggagggcagccttttgacttgggattgtgactggcaggggatgccattctggacctggtgaggttgccacggagtgtctctgttcccaaggcagaatcgtaagtcaagtccctggtcatccattctggcctttggactgcctgctcttaggtgtaaggccaggtggtcttggcccccatgacccacacagaactccccagggaaaagccctttggtcactgcccttactcatcaggatgaagagcgcacagtgaatcagagcaactgggggatcctgagccagcgggagtgggactctggag

SEQ ID NO: 71762 - DNA, 1441 bp, Homo sapiens
  misc_feature (46)..(47): n is a, c, g, or t
  misc_feature (70)..(70): n is a, c, g, or t
tctgctaggtcgagcctgggttgaatcggccgaggggctctgtgcnngtccggcgcgcgttctgctccgngcgggggcccggctcccgggcgcggccctcgggcggacggagcgggcggccggcggcggagacggcgcgcggcgcttcgggagccagcgggtgctggtggagccggacgcgggcgcaggggtcgctgtgatgaaattcaagaaccccccagtgaacagcctgagcctggagtttctgacggagctggtcatcagcctggagaagctggagaatgacaagagcttccgcggtgtcattctgacctcggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacggagcctgccccgctggaggctgcctggtggccctgacctgtgactaccgcatcctggcggacaaccccaggtactgcataggactcaatgagacccagctgggcatcatcgcccctttctggttgaaagacaccctggagaacaccatcgggcaccgggcggcggagcgtgccctgcagctggggctgctcttcccgccggcggaggccctgcaggtgggcatagtggaccaggtggtcccggaggagcaggtgcagagcactgcgctgtcagcgatagcccagtggatggccattccagaccatgctcgacagctgaccaaggccatgatgcgaaaggccacggccagccgcctggtcacgcagcgcgatgcggacgtgcagaacttcgtcagcttcatctccaaagactccatccagaagtccctgcagatgtacttagagaggctcaaagaagaaaaaggctaacgattgggctgccacaggcttacggccacacgtgcccctgtgggtcccagggaggtcttaaacaaggtatttttcaacttaaaagtactgccagcgtttcattttgctgatgttacgtagaagttcctgttcctcatagcccagtggcccaaggcccagccacacacaaacacacatgggtgcctgtgcccgtcaggcaaggggagttggagggcagccttttgacttgggattgtgactggcaggggatgccattctggacctggtgaggttgccacggagtgtctctgttcccaaggcagaatcgtaagtcaagtccctggtcatccattctggcctttggactgcctgctcttaggtgtaaggccaggtggtcttggcccccatgacccacacagaactccccagggaaaagccctttggtcactgcccttactcatcaggatgaagagcgcacagtgaatcagagcaactgggggatcctgagccagcgggagtgggactctggag

SEQ ID NO: 71763 - DNA, 1466 bp, Homo sapiens
catgatgttatgaggcgtccctgttttaattcatccggggcctgatgttcattgtagttactgtgcagatggctggcgactctgtactgctccgcgcgggggcccggctcccgggcgcggccctcgggcggacggagcgggcggccggcggcggagacggcgcgcggcgcttcgggagccagcgggtgctggtggagccggacgcgggcgcaggggtcgctgtgatgaaattcaagaaccccccagtgaacagcctgagcctggagtttctgacggagctggtcatcagcctggagaagctggagaatgacaagagcttccgcggtgtcattctgacctcggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacggagcctgccccgctggaggctgcctggtggccctgacctgtgactaccgcatcctggcggacaaccccaggtactgcataggactcaatgagacccagctgggcatcatcgcccctttctggttgaaagacaccctggagaacaccatcgggcaccgggcggcggagcgtgccctgcagctggggctgctcttcccgccggcggaggccctgcaggtgggcatagtggaccaggtggtcccggaggagcaggtgcagagcactgcgctgtcagcgatagcccagtggatggccattccagaccatgctcgacagctgaccaaggccatgatgcgaaaggccacggccagccgcctggtcacgcagcgcgatgcggacgtgcagaacttcgtcagcttcatctccaaagactccatccagaagtccctgcagatgtacttagagaggctcaaagaagaaaaaggctaacgattgggctgccacaggcttacggccacacgtgcccctgtgggtcccagggaggtcttaaacaaggtatttttcaacttaaaagtactgccagcgtttcattttgctgatgttacgtagaagttcctgttcctcatagcccagtggcccaaggcccagccacacacaaacacacatgggtgcctgtgcccgtcaggcaaggggagttggagggcagccttttgacttgggattgtgactggcaggggatgccattctggacctggtgaggttgccacggagtgtctctgttcccaaggcagaatcgtaagtcaagtccctggtcatccattctggcctttggactgcctgctcttaggtgtaaggccaggtggtcttggcccccatgacccacacagaactccccagggaaaagccctttggtcactgcccttactcatcaggatgaagagcgcacagtgaatcagagcaactgggggatcctgagccagcgggagtgggactctggag

SEQ ID NO: 71764 - DNA, 1402 bp, Homo sapiens
gggctaggtgcgaggccgtgtgttatgctcgggcggggcccggctcccgggcgcggccctcgggcggacggagcgggcggccggcggcggagacggcgcgcggcgcttcgggagccagcgggtgctggtggagccggacgcgggcgcaggggtcgctgtgatgaaattcaagaaccccccagtgaacagcctgagcctggagtttctgacggagctggtcatcagcctggagaagctggagaatgacaagagcttccgcggtgtcattctgacctcggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacggagcctgccccgctggaggctgcctggtggccctgacctgtgactaccgcatcctggcggacaaccccaggtactgcataggactcaatgagacccagctgggcatcatcgcccctttctggttgaaagacaccctggagaacaccatcgggcaccgggcggcggagcgtgccctgcagctggggctgctcttcccgccggcggaggccctgcaggtgggcatagtggaccaggtggtcccggaggagcaggtgcagagcactgcgctgtcagcgatagcccagtggatggccattccagaccatgctcgacagctgaccaaggccatgatgcgaaaggccacggccagccgcctggtcacgcagcgcgatgcggacgtgcagaacttcgtcagcttcatctccaaagactccatccagaagtccctgcagatgtacttagagaggctcaaagaagaaaaaggctaacgattgggctgccacaggcttacggccacacgtgcccctgtgggtcccagggaggtcttaaacaaggtatttttcaacttaaaagtactgccagcgtttcattttgctgatgttacgtagaagttcctgttcctcatagcccagtggcccaaggcccagccacacacaaacacacatgggtgcctgtgcccgtcaggcaaggggagttggagggcagccttttgacttgggattgtgactggcaggggatgccattctggacctggtgaggttgccacggagtgtctctgttcccaaggcagaatcgtaagtcaagtccctggtcatccattctggcctttggactgcctgctcttaggtgtaaggccaggtggtcttggcccccatgacccacacagaactccccagggaaaagccctttggtcactgcccttactcatcaggatgaagagcgcacagtgaatcagagcaactgggggatcctgagccagcgggagtgggactctggag

SEQ ID NO: 71765 - DNA, 1473 bp, Homo sapiens
gtgtcaagatggctgcttgtggcttccttgtgctgatgctcctgtgctgctgctgttcttgctcctgctgctgtgttgtgccctgtgtctccctgtgtgctgctgtgccctcgtgtgctgtgactggagctgtggcgtgcctggctgtgctccggcggcggagacggcgcgcggcgcttcgggagccagcgggtgctggtggagccggacgcgggcgcaggggtcgctgtgatgaaattcaagaaccccccagtgaacagcctgagcctggagtttctgacggagctggtcatcagcctggagaagctggagaatgacaagagcttccgcggtgtcattctgacctcggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacggagcctgccccgctggaggctgcctggtggccctgacctgtgactaccgcatcctggcggacaaccccaggtactgcataggactcaatgagacccagctgggcatcatcgcccctttctggttgaaagacaccctggagaacaccatcgggcaccgggcggcggagcgtgccctgcagctggggctgctcttcccgccggcggaggccctgcaggtgggcatagtggaccaggtggtcccggaggagcaggtgcagagcactgcgctgtcagcgatagcccagtggatggccattccagaccatgctcgacagctgaccaaggccatgatgcgaaaggccacggccagccgcctggtcacgcagcgcgatgcggacgtgcagaacttcgtcagcttcatctccaaagactccatccagaagtccctgcagatgtacttagagaggctcaaagaagaaaaaggctaacgattgggctgccacaggcttacggccacacgtgcccctgtgggtcccagggaggtcttaaacaaggtatttttcaacttaaaagtactgccagcgtttcattttgctgatgttacgtagaagttcctgttcctcatagcccagtggcccaaggcccagccacacacaaacacacatgggtgcctgtgcccgtcaggcaaggggagttggagggcagccttttgacttgggattgtgactggcaggggatgccattctggacctggtgaggttgccacggagtgtctctgttcccaaggcagaatcgtaagtcaagtccctggtcatccattctggcctttggactgcctgctcttaggtgtaaggccaggtggtcttggcccccatgacccacacagaactccccagggaaaagccctttggtcactgcccttactcatcaggatgaagagcgcacagtgaatcagagcaactgggggatcctgagccagcgggagtgggactctggag

SEQ ID NO: 71766 - DNA, 1432 bp, Homo sapiens
gcgcggagcattattgggtaccttaagtgccaaagagtatgctgtcgtcgaatccgggatggcgctggtggcttctgtgcgagtcccggcgcgcgttctgctccgcgcggccggcggcggagacggcgcgcggcgcttcgggagccagcgggtgctggtggagccggacgcgggcgcaggggtcgctgtgatgaaattcaagaaccccccagtgaacagcctgagcctggagtttctgacggagctggtcatcagcctggagaagctggagaatgacaagagcttccgcggtgtcattctgacctcggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacggagcctgccccgctggaggctgcctggtggccctgacctgtgactaccgcatcctggcggacaaccccaggtactgcataggactcaatgagacccagctgggcatcatcgcccctttctggttgaaagacaccctggagaacaccatcgggcaccgggcggcggagcgtgccctgcagctggggctgctcttcccgccggcggaggccctgcaggtgggcatagtggaccaggtggtcccggaggagcaggtgcagagcactgcgctgtcagcgatagcccagtggatggccattccagaccatgctcgacagctgaccaaggccatgatgcgaaaggccacggccagccgcctggtcacgcagcgcgatgcggacgtgcagaacttcgtcagcttcatctccaaagactccatccagaagtccctgcagatgtacttagagaggctcaaagaagaaaaaggctaacgattgggctgccacaggcttacggccacacgtgcccctgtgggtcccagggaggtcttaaacaaggtatttttcaacttaaaagtactgccagcgtttcattttgctgatgttacgtagaagttcctgttcctcatagcccagtggcccaaggcccagccacacacaaacacacatgggtgcctgtgcccgtcaggcaaggggagttggagggcagccttttgacttgggattgtgactggcaggggatgccattctggacctggtgaggttgccacggagtgtctctgttcccaaggcagaatcgtaagtcaagtccctggtcatccattctggcctttggactgcctgctcttaggtgtaaggccaggtggtcttggcccccatgacccacacagaactccccagggaaaagccctttggtcactgcccttactcatcaggatgaagagcgcacagtgaatcagagcaactgggggatcctgagccagcgggagtgggactctggag

SEQ ID NO: 71767 - DNA, 1373 bp, Homo sapiens
aggcgagctcagcccgcgacctttatcccgcgcgttgcggtcaagatggcgctggtggcttctgtgcgagtcccggcgcgcgttctgctccgcgcgggggcccggctcccgggcgcggccctcgggcggacggagcgggcggccggcggcggagacggcgcgcggcgcttcgggagccagcgggtgctggtggagccggacgcgggcgcaggggtcgctgtgatgaaattcaagaaccccccagtgaacagcctgagcctggagtttctgacggagctggtcatcagcctggagaagctggagaatgacaagagcttccgcggtgtcattctgacctcggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacggagcctgccccgctggaggctgcctggtggccctgacctgtgactaccgcatcctggcggacaaccccaggttgaaagacaccctggagaacaccatcgggcaccgggcggcggagcgtgccctgcagctggggctgctcttcccgccggcggaggccctgcaggtgggcatagtggaccaggtggtcccggaggagcaggtgcagagcactgcgctgtcagcgatagcccagtggatggccattccagaccatgctcgacagctgaccaaggccatgatgcgaaaggccacggccagccgcctggtcacgcagcgcgatgcggacgtgcagaacttcgtcagcttcatctccaaagactccatccagaagtccctgcagatgtacttagagaggctcaaagaagaaaaaggctaacgattgggctgccacaggcttacggccacacgtgcccctgtgggtcccagggaggtcttaaacaaggtatttttcaacttaaaaaaaaaaaaaaaaaaaaaacaaaaatttggttgggccgggccttgggccccttgaaaaagtttttataaaccttcgcgtttggggcgccgcgggccccgttgggttagtgttgaccgtgtggccaagagctgtgtttccctaaggggaagaccccgtgggctcatggagcctataggtcgttgggggtttctcttccacacaatataaaaaaacacgcgccgggggggcgaaacccgggaacgcggtcttcgtggaaacaaattctcccagagatgggagagtgtcctgaggagggtccattaatgggggagtctcttattcacacggggggaggctccaggcggacgcctggattattcaaattatagcccccggcccgggggtgt

SEQ ID NO: 71768 - DNA, 1830 bp, Homo sapiens
aggcgagctcagcccgcgacctttatcccgcgcgttgcggtcaagatggcgctggtggcttctgtgcgagtcccggcgcgcgttctgctccgcgcgggggcccggctcccgggcgcggccctcgggcggacggagcgggcggccggcggcggagacggcgcgcggcgcttcgggagccagcgggtgctggtggagccggacgcgggcgcaggggtcgctgtgatgaaattcaagaaccccccagtgaacagcctgagcctggagtttctgacggagctggtcatcagcctggagaagctggagaatgacaagagcttccgcggtgtcattctgacctcggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacggagcctgccccgctggaggctgcctggtggccctgacctgtgactaccgcatcctggcggacaaccccaggtactgcataggactcaatgagacccagctgggcatcatcgcccctttctggttgaaagacaccctggagaacaccatcgggcaccgggcggcggagcgtgccctgcagctggggctgctcttcccgccggcggaggccctgcaggtgggcatagtggaccaggtggtcccggaggagcaggtgcagagcactgcgctgtcagcgatagcccagtggatggccattccaggtgaggcacggggcatggcgggcgcccgatgatgctggggagaccagaaggttctccacccaaaggttttctgtggacatcgtgacttcgggagactgttgataatcacagccatgtgggtgtcaggaggctgctgtaacaacgcagcacagaccgggtggcccagaccgcagaagctcatctcacggtgctggagaccagaggtgcaaaatcaaagtgtgggcaggactgcacttcctccctgcgttccagggaggctccttcctgccccgcccacttctgctggctccaggcctccctgggcttgtgggcgcctcgctctaatctctgcctccatccttacgcagctttctcccctgtgtttctgtgggtctcaggtctctctctcccttctcaggacacctgccatgtgatttaggacctaccttaaatccaagatgatcccaacttaattacatctgcagagactctttccaaataaggtcacacttccaagttccagagcagtggttagggcttggacctatcttttggggcacacttttcaacctactacaaagacaattgtccacttcatagaaaaagagctggtcatatcagcgatggtatagaccagggcccagcaaattctgtctctaaagggccaggtggcttgtgggctctgtaggtaagacctttgtagcagaaagcagccacagaggagacgtaaactgacaggtatagctgtgttccggcaaagctttatggacagtgggccaggtgcggtggctcacgcctgtaatctcagcactttgggaggctgaggcaggcagatcacttgagatcaggagttcaagaccagcctggccaacatggtgaaaccccatctctataaaaatacaaaaattagccaggtgtggcggcgggcgcctgtagtcccagctactcgagaggctgaggcaggaggatggcgtgaacccgggaggcggagcttgcagtgagctgagatcgcaccactgtactctagcctgagcaacagagagcaggactctgtctcaaaaaaa

SEQ ID NO: 71769 - DNA, 682 bp, Homo sapiens
attagacccagctgggcatcatagcccagtggatggccattccagaccatgctcgacagctgaccaaggccatgatgcgaaaggccacggccagccgcctggtcacgcagcgcgatgcggacgtgcagaacttcgtcagcttcatctccaaagactccatccagaagtccctgcagatgtacttagagaggctcaaagaagaaaaaggctaacgattgggctgccacaggcttacggccacacgtgcccctgtgggtcccagggaggtcttaaacaaggtatttttcaacttaaaaaaaaaaaaaaaaaaaaaacaaaaatttggttgggccgggccttgggccccttgaaaaagtttttataaaccttcgcgtttggggcgccgcgggccccgttgggttagtgttgaccgtgtggccaagagctgtgtttccctaaggggaagaccccgtgggctcatggagcctataggtcgttgggggtttctcttccacacaatataaaaaaacacgcgccgggggggcgaaacccgggaacgcggtcttcgtggaaacaaattctcccagagatgggagagtgtcctgaggagggtccattaatgggggagtctcttattcacacggggggaggctccaggcggacgcctggattattcaaattatagcccccggcccgggggtgt

SEQ ID NO: 71770 - DNA, 400 bp, Homo sapiens
gtatagaccagggcccagcaaattctgtctctaaagggccaggtggcttgtgggctctgtaggtaagacctttgtagcagaaagcagccacagaggagacgtaaactgacaggtatagctgtgttccggcaaagctttatggacagtgggccaggtgcggtggctcacgcctgtaatctcagcactttgggaggctgaggcaggcagatcacttgagatcaggagttcaagaccagcctggccaacatggtgaaaccccatctctactaaaaatacagaaatgggccaggcgcggtggctcacacctgtaatcccaacattttaagaggccgaggcgggcggatcacaaggtcaggagatcaagaccatcctggctaacacggtgaaaccctgtctctac

SEQ ID NO: 71771 - DNA, 350 bp, Homo sapiens
aacctgggatgtgtggccttctggccaagcatctgtcatttcatattgttggagcattccttataaccctggggttgcagctctctgtaagtttgctgtggcctgaccaagaaagaaggcatatgcagatttctacagaaattataattgaattaaagaatttgaggtgaggaaggctaatatctctcagagtacaaagtgattttggaacataaagtatttctttgggttgaattacatagaagtttgtcactgtacctgtgttcctgaactatctgtgaaacatgaatatgtgggctaagaaattgtttatcttaataaataattaacaaacactttgaacggttaaa

SEQ ID NO: 71772 - DNA, 407 bp, Homo sapiens
gcgagaccgaagccctgagagggcaaatggactgccgaaagctacacaggtacaggtcagcagggcaggtcaatctattatttatttatttatttatttttgacagagtctcgctctgtcgcccaggctggagtgcagtggcgtgatctcggctcactgcaagcttcgcctcctgggttcacggcattctcctgcctcagcctcccaagtagctgggaatacaggcacccaccaccatgcctggctaattttttggtttttttttagtaaagacggggtttcaccgtgttagccaggatagtcttgatctcctgacctcgtgatctgcccacctcggcctcccaaagtgctgggattacaggcatgagccaccgcgcccggcagattggcttctttcacctagtaaa

SEQ ID NO: 71773 - DNA, 375 bp, Homo sapiens
tgccatcttacacttaatagactacagtatagtgaaaacataacctgtatatacactgagaaaccaaaatcttcatgtgacttgctttattgcagtggtctggaactgaactcacaatatatctgaggtatgcctgtatttcaggaagtctaacaaaaaccacgcatcatttgtctgtgggaagagggtatagtataattgaaatgtcaaggtttttcaatagtttgcttttaatggaataatagttgctaggtgtggtaacactggttatctcatgaaaaaaggaattaacatatacaatttgtttcagataaaagatttacaaagtatagggaacatacgtgaaataataaaagtgtctttgtattgtgttcc

SEQ ID NO: 71774 - DNA, 692 bp, Homo sapiens
actttggcaaccctgggggtgagagtgaaggcctcaagatgcctgtcctgtaggtatctctggtgagcaaggccggggacatgttacgggacaagctacaggctgatttgtctcttcatagtgtagattgcagagtgggacaaatgttgggctcctcttcctcccttatggaggtagaatttgtgtgtgtcaatgcctgcacctgagtgttcatcctgatgggcttttacatgtgtgtatacccatgtaactactgctctgatcatgttatagaataagggtatccaatctttttgcttccctgggccacattggaagaagaattttcttgggccacacctaaaatacgctaacactaatgataactggtgagctaaataaaacaagcaaaaataaaaataaaaaataaagtcacaaaaaagtctcataatgttttaagaaagtttatgaatttgtgttgggccacattcaaagctgcctgggccgcatatggactgcaggttagacaagcatgttatagaacatttccatcaccttagggggcttccaagtaccccctcccagtccgtgcaccccagaggtaaccaccattctgactctaccccaaggactactctcgcctgccttcatgatgtgggctttttcccttagtctagtgggagatcttggcccttagctcaggggagggaggc

SEQ ID NO: 71775 - DNA, 402 bp, Homo sapiens
ggtacaacattcatcggatggtgagtataggagcaagcttaaaatctgttctatcattctgaggggctcttggcctctattttaaaatcaaatcaaatcaatcaacaggcatccttcagctggttaaaaatatgcttatcacgactgccattctaaggcctcagatgttaggcttgctggtggagaacacggagaacccccctcaatacccacgggtcattgggagtgtcggccgtgtttcgaatcagtttcctttcacggggaaaccttaccatcgcgtgaggctgggaaagttctggccaggacacaccctggcgttattcaaaggcctctgggtcggacccagcctccaacagcccatttcgggttttggcagagaatccccagctatcctgtcacaaa

SEQ ID NO: 71776 - DNA, 299 bp, Homo sapiens
gcctactactactaaattcgcggccgcgtcgaccagaaaatgatcaggatggtgaaagcaatcagcaaagagaccatgacttttcagccatgagtttctggttccagttctattctgattgttacaaatgctctttatttatcagtaactctaattaactgggttagtacatgtaccaggaacagcataagccccctgccacacttggtggtaattccacagagacaccaaatacttcaatgtcccagggactgtattagaatatgttactttccttttctattaaaagttatttcttg

SEQ ID NO: 71777 - DNA, 377 bp, Homo sapiens
ttttgtctttcctttgtgttcttgagcccatacccctcacttcattaatttattagcacattcactcattcatttttcaggtatttactgagcatctattaaatgccaggtagaactacaaagggggatatggcttaggcctctgcctcagggaactcctaggagtaaaagtaagcatgttatgaaataaatgcaaatgcagtgcggtaaatgaacacagatagctgcaacagatagagctcaaaattaagacctacaagtgatgacttttcctcctgaaacatccccttgggcatttccatttctctctctctgcccctcctctctggtttcatctaacttttactttctctaacttagtacttcatcaaactttg

SEQ ID NO: 71778 - DNA, 483 bp, Homo sapiens
agtagagacggggtttcaccatattggccaggctggtcttgaactcctgacctcaagtgatccacctgcctccacctcccaaagtgctgggattacaggtgtgagccaccgcccccagcaccctcagatgtttaatttacaaaatagtgtatgtgtgttgggagagggcagccttaaaagatgtcagggttttaccatccacttgacaaccccgcctggcagtcagtgacattctagacatctctggaactttccacttggttgttccgtgtaccagggtgaaccatgtggatttttagttgcagagtgtactgcgagttaagtggaaaggtctgagagagagagaaatgaggggtgggaaagagatcatagcccttgacagctggaaaaggctttgtgcttctctttctctgcccctttcctggggcaagggaggagggcagatggcacaggattgggtagcagtgggggagaatgaatgct

SEQ ID NO: 71779 - DNA, 3953 bp, Homo sapiens
cctacctggccatggccaacggagtgatcccgccgcccgggggcgcctcccccctaccccaggtccgggtgcccttggaggagccccctctaagtccagacgtggaggaggaggacgatgacttgggcaagaccttggctgtgagcaggtttggggacctcatcagcaagcccccggcctgggaccccgagaagcccagccgcagctacagcgagcgggactttgagtttcaccggcacacatcccaccacacccaccacccgctctcagcgcgcctgcctccaccccacaagctgcggcggctgccccccacctctgcccggcacaccaggagaaagaggaagaaggagaaaacctctgctcctccctccgaggggacccctcccatccaggaggaggggggagctggagtggatgaggaagaggaggaagaggaggaagaggaaggagaatctgaggcagaacctgtggagccccccccctcagggaccccacagaaggcaaagttctccattggaagtgacgaggatgacagtccaggcctccctgggagggctgctgtcaccaagcccctgccctcggtgggcccacacactgacaagagcccccagcactccagcagctcccccagcccccgggcccgggcctcccgactcgctggggagaaaagccggccctggagcccatcggccagttatgacctgcgggagcgactgtgcccaggcagtgccctgggcaacccaggtggtccagagcagcaggtgcccacagatgaggcggaggcccagatgctgggttctgcagacctggacgacatgaagagtcaccgactggaggacaaccctggtgtgcggcgacacttagtgaaaaagccctcccggacgcagggcgggaggggcagtcccagcggcctggcccccatccttcgcaggaagaagaagaagaaaaagctggaccggaggcctcatgaggtgttcgtggagctgaacgagctgatgctggaccgcagccaggagccccactggcgggagacggcccgctggatcaagtttgaggaggacgtggaggaggagacggagcgctgggggaagccccatgttgcctcgctctccttccgtagccttctggagctcaggaggaccatcgcccatggagctgccctcctggacctggagcaaaccaccctgccaggcattgcacacctcgtggtggagaccatgattgtgtctgaccagatccggccggaggacagggccagcgtcctacgtaccctgctactgaagcacagccatcccaacgatgacaaggacagtggcttctttccccgaaacccatcgagctccagcatgaactcggttctggggaatcatcacccaactcccagccatggccctgatggggcggtgcctaccatggctgatgacctgggggagccagccccactctggccacatgaccctgacgccaaggagaagcccctccacatgcctgggggagatggtcaccgggggaaaagcctgaagctgctggagaagatccctgaagatgctgaggccacggttgtgcttgtgggttgtgtgcctttcttggagcagcctgcagcagccttcgtgcgtctgaatgaggctgtactcctggagtctgtgcttgaggtccctgtcccggtccgcttcctcttcgtgatgctggggcccagccacaccagcactgactatcacgagcttgggcgctccattgccacccttatgtctgacaagctgtttcatgaggctgcctaccaggcagatgaccggcaagacctcctaagtgccatcagcgagttcctggatggcagcattgtgatccccccgtccgaggtggagggccgtgacctgctgcgctccgtggctgctttccagcgagagctgcttaggaagcggcgagagcgtgaacagaccaaagtcgagatgaccacacggggtggctacacggcccctgggaaagaactgtctttggagttggggggctctgaggcgacccctgaagatgaccccttgctgcggacgggctcggtatttggggggcttgtgcgggatgtgaggcgccggtacccgcactaccccagtgacctgcgagatgcgctgcactcccagtgtgtggccgctgtgctcttcatctacttcgcagccctcagccctgccatcaccttcggggggctgctgggagagaagaccgaggggctgatgggcgtgtccgagctgatcgtgtccaccgctgtgctcggcgtcctcttctctctgctgggagctcagccgctgcttgtggttggcttctctgggccgctgcttgtgtttgaggaagccttcttcaagttctgccgagcccaggacctggagtacctcactggccgggtgtgggttggtctctggctggtggtcttcgtccttgccctggtggccgccgaaggcagcttcctggtccgctacatctcgcctttcacccaggagatctttgcctttctcatctcactcattttcatctacgagaccttctacaagctctacaaggtgttcacagagcacccactgctgccgttctacccccctgagggggccctggaggggtccctggctgctggtctggagccaaatggcagtgccctgccccccaccgagggcccccccagcccgaggaaccagcccaatacggcactgctctcactcatcctcatgctcgggaccttcttcatagccttcttcctgcgcaagttcaggaacagccgcttcctggggggcaaggctcgtcgcatcatcggggactttggcatccccatctccatcctggtgatggtcctggtggattactccatcacagacacctacacgcagaagctgacagtgcctacagggctctcagtgacctctcccgataagcgctcgtggttcatcccacccctgggcagtgcccgtcctttcccgccgtggatgatggtggcagccgctgttcccgccctcctcgtcctcatcctgatcttcatggagacacagatcacggcgcttatcgtcagccagaaggcgcggaggctgctcaagggctccggtttccacctggacctgctcctcattggctccctgggggggctctgtgggctgtttgggttgccctggctcacggctgccacggtccgctccgtcacccatgtcaatgcgttgacagtgatgcgtactgccatcgcgcctggtgacaagccccagatccaggaggtgcgggagcagcgggtcactggtgtgctcatcgccagcctcgtgggcctgtccatcgtcatgggggctgtgctgcgtcggatcccattggctgtgctctttgggatcttcctgtacatgggggtcacgtccctgtctggtatccagctgtcccagcgtctgttgctcatcctcatgccggcaaaacaccatcctgagcagccctatgtgaccaaggtgaagacgtggcggatgcatctgttcacctgcatccagctgggctgcatcgcactgctctgggtggtcaagtccacggcggcctcactcgcctttcccttcctgctgctgctcacggtgcctctgaggcattgccttctgccccggctcttccaggacagggagctgcaggcgctggactcggaagatgctgaaccaaacttcgatgaggatggccaggatgagtacaatgagctgcacatgccagtgtgacccttgaagacagtgcccctcagagaccccaagaccttagggattgacacctgggcctcaggcagagcccagccctgggctggggggctcctcaggacccagagatgtgcctggaaccactcctgatgccatggctagagtggcccccctgacttctgcccggggtgttgacctcgcctcacctttcacagaccagaccggcacaggctttgagctcattataaccacactccttgtctcgtg

SEQ ID NO: 71780 - DNA, 3081 bp, Homo sapiens
cgagtcggtgacaagttggtgccctgccatcccagcggcctggcccccatccttcgcaggaagaagaagaagaaaaagctggaccggaggcctcatgaggtgttcgtggagctgaacgagctgatgctggaccgcagccaggagccccactggcgggagacggcccgctggatcaagtttgaggaggacgtggaggaggagacggagcgctgggggaagccccatgttgcctcgctctccttccgtagccttctggagctcaggaggaccatcgcccatggagctgccctcctggacctggagcaaaccaccctgccaggcattgcacacctcgtggtggagaccatgattgtgtctgaccagatccggccggaggacagggccagcgtcctacgtaccctgctactgaagcacagccatcccaacgatgacaaggacagtggcttctttccccgaaacccatcgagctccagcatgaactcggttctggggaatcatcacccaactcccagccatggccctgatggggcggtgcctaccatggctgatgacctgggggagccagccccactctggccacatgaccctgacgccaaggagaagcccctccacatgcctgggggagatggtcaccgggggaaaagcctgaagctgctggagaagatccctgaagatgctgaggccacggttgtgcttgtgggttgtgtgcctttcttggagcagcctgcagcagccttcgtgcgtctgaatgaggctgtactcctggagtctgtgcttgaggtccctgtcccggtccgcttcctcttcgtgatgctggggcccagccacaccagcactgactatcacgagcttgggcgctccattgccacccttatgtctgacaagctgtttcatgaggctgcctaccaggcagatgaccggcaagacctcctaagtgccatcagcgagttcctggatggcagcattgtgatccccccgtccgaggtggagggccgtgacctgctgcgctccgtggctgctttccagcgagagctgcttaggaagcggcgagagcgtgaacagaccaaagtcgagatgaccacacggggtggctacacggcccctgggaaagaactgtctttggagttggggggctctgaggcgacccctgaagatgaccccttgctgcggacgggctcggtatttggggggcttgtgcgggatgtgaggcgccggtacccgcactaccccagtgacctgcgagatgcgctgcactcccagtgtgtggccgctgtgctcttcatctacttcgcagccctcagccctgccatcaccttcggggggctgctgggagagaagaccgaggggctgatgggcgtgtccgagctgatcgtgtccaccgctgtgctcggcgtcctcttctctctgctgggagctcagccgctgcttgtggttggcttctctgggccgctgcttgtgtttgaggaagccttcttcaagttctgccgagcccaggacctggagtacctcactggccgggtgtgggttggtctctggctggtggtcttcgtccttgccctggtggccgccgaaggcagcttcctggtccgctacatctcgcctttcacccaggagatctttgcctttctcatctcactcattttcatctacgagaccttctacaagctctacaaggtgttcacagagcacccactgctgccgttctacccccctgagggggccctggaggggtccctggctgctggtctggagccaaatggcagtgccctgccccccaccgagggcccccccagcccgaggaaccagcccaatacggcactgctctcactcatcctcatgctcgggaccttcttcatagccttcttcctgcgcaagttcaggaacagccgcttcctggggggcaaggctcgtcgcatcatcggggactttggcatccccatctccatcctggtgatggtcctggtggattactccatcacagacacctacacgcagaagctgacagtgcctacagggctctcagtgacctctcccgataagcgctcgtggttcatcccacccctgggcagtgcccgtcctttcccgccgtggatgatggtggcagccgctgttcccgccctcctcgtcctcatcctgatcttcatggagacacagatcacggcgcttatcgtcagccagaaggcgcggaggctgctcaagggctccggtttccacctggacctgctcctcattggctccctgggggggctctgtgggctgtttgggttgccctggctcacggctgccacggtccgctccgtcacccatgtcaatgcgttgacagtgatgcgtactgccatcgcgcctggtgacaagccccagatccaggaggtgcgggagcagcgggtcactggtgtgctcatcgccagcctcgtgggcctgtccatcgtcatgggggctgtgctgcgtcggatcccattggctgtgctctttgggatcttcctgtacatgggggtcacgtccctgtctggtatccagctgtcccagcgtctgttgctcatcctcatgccggcaaaacaccatcctgagcagccctatgtgaccaaggtgaagacgtggcggatgcatctgttcacctgcatccagctgggctgcatcgcactgctctgggtggtcaagtccacggcggcctcactcgcctttcccttcctgctgctgctcacggtgcctctgaggcattgccttctgccccggctcttccaggacagggagctgcaggcgctggactcggaagatgctgaaccaaacttcgatgaggatggccaggatgagtacaatgagctgcacatgccagtgtgacccttgaagacagtgcccctcagagaccccaagaccttagggattgacacctgggcctcaggcagagcccagccctgggctggggggctcctcaggacccagagatgtgcctggaaccactcctgatgccatggctagagtggcccccctgacttctgcccggggtgttgacctcgcctcacctttcacagaccagaccggcacaggctttgagctcattataaccacactccttgtctcgtg

SEQ ID NO: 71781 - DNA, 4034 bp, Homo sapiens
cctacctggccatggccaacggagtgatcccgccgcccgggggcgcctcccccctaccccaggtccgggtgcccttggaggagccccctctaagtccagacgtggaggaggaggacgatgacttgggcaagaccttggctgtgagcaggtttggggacctcatcagcaagcccccggcctgggaccccgagaagcccagccgcagctacagcgagcgggactttgagtttcaccggcacacatcccaccacacccaccacccgctctcagcgcgcctgcctccaccccacaagctgcggcggctgccccccacctctgcccggcacaccaggagaaagaggaagaaggagaaaacctctgctcctccctccgaggggacccctcccatccaggaggaggggggagctggagtggatgaggaagaggaggaagaggaggaagaggaaggagaatctgaggcagaacctgtggagccccccccctcagggaccccacagaaggcaaagttctccattggaagtgacgaggatgacagtccaggcctccctgggagggctgctgtcaccaagcccctgccctcggtgggcccacacactgacaagagcccccagcactccagcaggccgtgctctgagctgagggacggtgatggaaccaccgacctggccctgtcaagtccaaggctgctgtgttgcctccccagctcccccagcccccgggcccgggcctcccgactcgctggggagaaaagccggccctggagcccatcggccagttatgacctgcgggagcgactgtgcccaggcagtgccctgggcaacccaggtggtccagagcagcaggtgcccacagatgaggcggaggcccagatgctgggttctgcagacctggacgacatgaagagtcaccgactggaggacaaccctggtgtgcggcgacacttagtgaaaaagccctcccggacgcagggcgggaggggcagtcccagcggcctggcccccatccttcgcaggaagaagaagaagaaaaagctggaccggaggcctcatgaggtgttcgtggagctgaacgagctgatgctggaccgcagccaggagccccactggcgggagacggcccgctggatcaagtttgaggaggacgtggaggaggagacggagcgctgggggaagccccatgttgcctcgctctccttccgtagccttctggagctcaggaggaccatcgcccatggagctgccctcctggacctggagcaaaccaccctgccaggcattgcacacctcgtggtggagaccatgattgtgtctgaccagatccggccggaggacagggccagcgtcctacgtaccctgctactgaagcacagccatcccaacgatgacaaggacagtggcttctttccccgaaacccatcgagctccagcatgaactcggttctggggaatcatcacccaactcccagccatggccctgatggggcggtgcctaccatggctgatgacctgggggagccagccccactctggccacatgaccctgacgccaaggagaagcccctccacatgcctgggggagatggtcaccgggggaaaagcctgaagctgctggagaagatccctgaagatgctgaggccacggttgtgcttgtgggttgtgtgcctttcttggagcagcctgcagcagccttcgtgcgtctgaatgaggctgtactcctggagtctgtgcttgaggtccctgtcccggtccgcttcctcttcgtgatgctggggcccagccacaccagcactgactatcacgagcttgggcgctccattgccacccttatgtctgacaagctgtttcatgaggctgcctaccaggcagatgaccggcaagacctcctaagtgccatcagcgagttcctggatggcagcattgtgatccccccgtccgaggtggagggccgtgacctgctgcgctccgtggctgctttccagcgagagctgcttaggaagcggcgagagcgtgaacagaccaaagtcgagatgaccacacggggtggctacacggcccctgggaaagaactgtctttggagttggggggctctgaggcgacccctgaagatgaccccttgctgcggacgggctcggtatttggggggcttgtgcgggatgtgaggcgccggtacccgcactaccccagtgacctgcgagatgcgctgcactcccagtgtgtggccgctgtgctcttcatctacttcgcagccctcagccctgccatcaccttcggggggctgctgggagagaagaccgaggggctgatgggcgtgtccgagctgatcgtgtccaccgctgtgctcggcgtcctcttctctctgctgggagctcagccgctgcttgtggttggcttctctgggccgctgcttgtgtttgaggaagccttcttcaagttctgccgagcccaggacctggagtacctcactggccgggtgtgggttggtctctggctggtggtcttcgtccttgccctggtggccgccgaaggcagcttcctggtccgctacatctcgcctttcacccaggagatctttgcctttctcatctcactcattttcatctacgagaccttctacaagctctacaaggtgttcacagagcacccactgctgccgttctacccccctgagggggccctggaggggtccctggctgctggtctggagccaaatggcagtgccctgccccccaccgagggcccccccagcccgaggaaccagcccaatacggcactgctctcactcatcctcatgctcgggaccttcttcatagccttcttcctgcgcaagttcaggaacagccgcttcctggggggcaaggctcgtcgcatcatcggggactttggcatccccatctccatcctggtgatggtcctggtggattactccatcacagacacctacacgcagaagctgacagtgcctacagggctctcagtgacctctcccgataagcgctcgtggttcatcccacccctgggcagtgcccgtcctttcccgccgtggatgatggtggcagccgctgttcccgccctcctcgtcctcatcctgatcttcatggagacacagatcacggcgcttatcgtcagccagaaggcgcggaggctgctcaagggctccggtttccacctggacctgctcctcattggctccctgggggggctctgtgggctgtttgggttgccctggctcacggctgccacggtccgctccgtcacccatgtcaatgcgttgacagtgatgcgtactgccatcgcgcctggtgacaagccccagatccaggaggtgcgggagcagcgggtcactggtgtgctcatcgccagcctcgtgggcctgtccatcgtcatgggggctgtgctgcgtcggatcccattggctgtgctctttgggatcttcctgtacatgggggtcacgtccctgtctggtatccagctgtcccagcgtctgttgctcatcctcatgccggcaaaacaccatcctgagcagccctatgtgaccaaggtgaagacgtggcggatgcatctgttcacctgcatccagctgggctgcatcgcactgctctgggtggtcaagtccacggcggcctcactcgcctttcccttcctgctgctgctcacggtgcctctgaggcattgccttctgccccggctcttccaggacagggagctgcaggcgctggactcggaagatgctgaaccaaacttcgatgaggatggccaggatgagtacaatgagctgcacatgccagtgtgacccttgaagacagtgcccctcagagaccccaagaccttagggattgacacctgggcctcaggcagagcccagccctgggctggggggctcctcaggacccagagatgtgcctggaaccactcctgatgccatggctagagtggcccccctgacttctgcccggggtgttgacctcgcctcacctttcacagaccagaccggcacaggctttgagctcattataaccacactccttgtctcgtg

SEQ ID NO: 71782 - DNA, 2061 bp, Homo sapiens
aggatctcgtagctcggagtgacgagagttgacagaactagtatcattaacattgaccactggggtgatggttacaatgcgcctgggaaagaactgtctttggagttggggggctctgaggcgacccctgaagatgaccccttgctgcggacgggctcggtatttggggggcttgtgcgggatgtgaggcgccggtacccgcactaccccagtgacctgcgagatgcgctgcactcccagtgtgtggccgctgtgctcttcatctacttcgcagccctcagccctgccatcaccttcggggggctgctgggagagaagaccgaggggctgatgggcgtgtccgagctgatcgtgtccaccgctgtgctcggcgtcctcttctctctgctgggagctcagccgctgcttgtggttggcttctctgggccgctgcttgtgtttgaggaagccttcttcaagttctgccgagcccaggacctggagtacctcactggccgggtgtgggttggtctctggctggtggtcttcgtccttgccctggtggccgccgaaggcagcttcctggtccgctacatctcgcctttcacccaggagatctttgcctttctcatctcactcattttcatctacgagaccttctacaagctctacaaggtgttcacagagcacccactgctgccgttctacccccctgagggggccctggaggggtccctggctgctggtctggagccaaatggcagtgccctgccccccaccgagggcccccccagcccgaggaaccagcccaatacggcactgctctcactcatcctcatgctcgggaccttcttcatagccttcttcctgcgcaagttcaggaacagccgcttcctggggggcaaggctcgtcgcatcatcggggactttggcatccccatctccatcctggtgatggtcctggtggattactccatcacagacacctacacgcagaagctgacagtgcctacagggctctcagtgacctctcccgataagcgctcgtggttcatcccacccctgggcagtgcccgtcctttcccgccgtggatgatggtggcagccgctgttcccgccctcctcgtcctcatcctgatcttcatggagacacagatcacggcgcttatcgtcagccagaaggcgcggaggctgctcaagggctccggtttccacctggacctgctcctcattggctccctgggggggctctgtgggctgtttgggttgccctggctcacggctgccacggtccgctccgtcacccatgtcaatgcgttgacagtgatgcgtactgccatcgcgcctggtgacaagccccagatccaggaggtgcgggagcagcgggtcactggtgtgctcatcgccagcctcgtgggcctgtccatcgtcatgggggctgtgctgcgtcggatcccattggctgtgctctttgggatcttcctgtacatgggggtcacgtccctgtctggtatccagctgtcccagcgtctgttgctcatcctcatgccggcaaaacaccatcctgagcagccctatgtgaccaaggtgaagacgtggcggatgcatctgttcacctgcatccagctgggctgcatcgcactgctctgggtggtcaagtccacggcggcctcactcgcctttcccttcctgctgctgctcacggtgcctctgaggcattgccttctgccccggctcttccaggacagggagctgcaggcgctggactcggaagatgctgaaccaaacttcgatgaggatggccaggatgagtacaatgagctgcacatgccagtgtgacccttgaagacagtgcccctcagagaccccaagaccttagggattgacacctgggcctcaggcagagcccagccctgggctggggggctcctcaggacccagagatgtgcctggaaccactcctgatgccatggctagagtggcccccctgacttctgcccggggtgttgacctcgcctcacctttcacagaccagaccggcacaggctttgagctcattataaccacactccttgtctcgtg

SEQ ID NO: 71783 - DNA, 908 bp, Homo sapiens
ccaaagtgctgggattacaggcgtgagccaatgtgtctgcccccccccccgcccctccttctcttgttcagggtgataaggccaagttgattggtccagtgggtccatgtcgcctccccccaggcctctccatcctcacgggggctgtctgagggtcaggcagatctgtgtcacctcttccaggcctgtccatcctcacgggggctgtctgagggtcaggcgggtctgtgtcacctcctccaggcctgtccatcgtcatgggggctgtgctgcgtcggatcccattggctgtgctctttgggatcttcctgtacatgggggtcacgtccctgtctggtatccagctgtcccagcgtctgttgctcatcctcatgccggcaaaacaccatcctgagcagccctatgtgaccaaggtgaagacgtggcggatgcatctgttcacctgcatccagctgggctgcatcgcactgctctgggtggtcaagtccacggcggcctcactcgcctttcccttcctgctgctgctcacggtgcctctgaggcattgccttctgccccggctcttccaggacagggagctgcaggcgctggactcggaagatgctgaaccaaacttcgatgaggatggccaggatgagtacaatgagctgcacatgccagtgtgacccttgaagacagtgcccctcagagaccccaagaccttagggattgacacctgggcctcaggcagagcccagccctgggctggggggctcctcaggacccagagatgtgcctggaaccactcctgatgccatggctagagtggcccccctgacttctgcccggggtgttgacctcgcctcacctttcacagaccagaccggcacaggctttgagctcattataaccacactccttgtctcgtg

SEQ ID NO: 71784 - DNA, 3634 bp, Homo sapiens
cctacctggccatggccaacggagtgatcccgccgcccgggggcgcctcccccctaccccaggtccgggtgcccttggaggagccccctctaagtccagacgtggaggaggaggacgatgacttgggcaagaccttggctgtgagcaggtttggggacctcatcagcaagcccccggcctgggaccccgagaagcccagccgcagctacagcgagcgggactttgagtttcaccggcacacatcccaccacacccaccacccgctctcagcgcgcctgcctccaccccacaagctgcggcggctgccccccacctctgcccggcacaccaggagaaagaggaagaaggagaaaacctctgctcctccctccgaggggacccctcccatccaggaggaggggggagctggagtggatgaggaagaggaggaagaggaggaagaggaaggagaatctgaggcagaacctgtggagccccccccctcagggaccccacagaaggcaaagttctccattggaagtgacgaggatgacagtccaggcctccctgggagggctgctgtcaccaagcccctgccctcggtgggcccacacactgacaagagcccccagcactccagcaggccgtgctctgagctgagggacggtgatggaaccaccgacctggccctgtcaagtccaaggctgctgtgttgcctccccagctcccccagcccccgggcccgggcctcccgactcgctggggagaaaagccggccctggagcccatcggccagttatgacctgcgggagcgactgtgcccaggcagtgccctgggcaacccaggtggtccagagcagcaggtgcccacagatgaggcggaggcccagatgctgggttctgcagacctggacgacatgaagagtcaccgactggaggacaaccctggtgtgcggcgacacttagtgaaaaagccctcccggacgcagggcgggaggggcagtcccagcggcctggcccccatccttcgcaggaagaagaagaagaaaaagctggaccggaggcctcatgaggtgttcgtggagctgaacgagctgatgctggaccgcagccaggagccccactggcgggagacggcccgctggatcaagtttgaggaggacgtggaggaggagacggagcgctgggggaagccccatgttgcctcgctctccttccgtagccttctggagctcaggaggaccatcgcccatggagctgccctcctggacctggagcaaaccaccctgccaggcattgcacacctcgtggtggagaccatgattgtgtctgaccagatccggccggaggacagggccagcgtcctacgtaccctgctactgaagcacagccatcccaacgatgacaaggacagtggcttctttccccgaaacccatcgagctccagcatgaactcggttctggggaatcatcacccaactcccagccatggccctgatggggcggtgcctaccatggctgatgacctgggggagccagccccactctggccacatgaccctgacgccaaggagaagcccctccacatgcctgggggagatggtcaccgggggaaaagcctgaagctgctggagaagatccctgaagatgctgaggccacggttgtgcttgtgggttgtgtgcctttcttggagcagcctgcagcagccttcgtgcgtctgaatgaggctgtactcctggagtctgtgcttgaggtccctgtcccggtccgcttcctcttcgtgatgctggggcccagccacaccagcactgactatcacgagcttgggcgctccattgccacccttatgtctgacaagctgtttcatgaggctgcctaccaggcagatgaccggcaagacctcctaagtgccatcagcgagttcctggatggcagcattgtgatccccccgtccgaggtggagggccgtgacctgctgcgctccgtggctgctttccagcgagagctgcttaggaagcggcgagagcgtgaacagaccaaagtcgagatgaccacacggggtggctacacggcccctgggaaagaactgtctttggagttggggggctctgaggcgacccctgaagatgaccccttgctgcggacgggctcggtatttggggggcttgtgcgggatgtgaggcgccggtacccgcactaccccagtgacctgcgagatgcgctgcactcccagtgtgtggccgctgtgctcttcatctacttcgcagccctcagccctgccatcaccttcggggggctgctgggagagaagaccgaggggctgatgggcgtgtccgagctgatcgtgtccaccgctgtgctcggcgtcctcttctctctgctgggagctcagccgctgcttgtggttggcttctctgggccgctgcttgtgtttgaggaagccttcttcaagttctgccgagcccaggacctggagtacctcactggccgggtgtgggttggtctctggctggtggtcttcgtccttgccctggtggccgccgaaggcagcttcctggtccgctacatctcgcctttcacccaggagatctttgcctttctcatctcactcattttcatctacgagaccttctacaagctctacaaggtgttcacagagcacccactgctgccgttctacccccctgagggggccctggaggggtccctggctgctggtctggagccaaatggcagtgccctgccccccaccgagggcccccccagcccgaggaaccagcccaatacggcactgctctcactcatcctcatgctcgggaccttcttcatagccttcttcctgcgcaagttcaggaacagccgcttcctggggggcaaggctcgtcgcatcatcggggactttggcatccccatctccatcctggtgatggtcctggtggattactccatcacagacacctacacgcagaagctgacagtgcctacagggctctcagtgacctctcccgataagcgctcgtggttcatcccacccctgggcagtgcccgtcctttcccgccgtggatgatggtggcagccgctgttcccgccctcctcgtcctcatcctgatcttcatggagacacagatcacggcgcttatcgtcagccagaaggcgcggaggctgctcaagggctccggtttccacctggacctgctcctcattggctccctgggggggctctgtgggctgtttgggttgccctggctcacggctgccacggtccgctccgtcacccatgtcaatgcgttgacagtgatgcgtactgccatcgcgcctggtgacaagccccagatccaggaggtgcgggagcagcgggtcactggtgtgctcatcgccagcctcgtgggtgagagcccgcctccaccctgcacacccccttccttgggccccacggtcttacatcttcactatcccaggcttgaccctgaatctcccaatgtgctgtgtgttgccctcaatctgacccccaaacctgcttcccagcactcccctagccctttactcctggagtccttttctggctctctgtcctgccccctcttctctctctttttttttgagacggagtctcgctctgtcacccaggctggagtgcagtggcgcgatctcgg

SEQ ID NO: 71785 - DNA, 2816 bp, Homo sapiens
cctacctggccatggccaacggagtgatcccgccgcccgggggcgcctcccccctaccccaggtccgggtgcccttggaggagccccctctaagtccagacgtggaggaggaggacgatgacttgggcaagaccttggctgtgagcaggtttggggacctcatcagcaagcccccggcctgggaccccgagaagcccagccgcagctacagcgagcgggactttgagtttcaccggcacacatcccaccacacccaccacccgctctcagcgcgcctgcctccaccccacaagctgcggcggctgccccccacctctgcccggcacaccaggagaaagaggaagaaggagaaaacctctgctcctccctccgaggggacccctcccatccaggaggaggggggagctggagtggatgaggaagaggaggaagaggaggaagaggaaggagaatctgaggcagaacctgtggagccccccccctcagggaccccacagaaggcaaagttctccattggaagtgacgaggatgacagtccaggcctccctgggagggctgctgtcaccaagcccctgccctcggtgggcccacacactgacaagagcccccagcactccagcaggccgtgctctgagctgagggacggtgatggaaccaccgacctggccctgtcaagtccaaggctgctgtgttgcctccccagctcccccagcccccgggcccgggcctcccgactcgctggggagaaaagccggccctggagcccatcggccagttatgacctgcgggagcgactgtgcccaggcagtgccctgggcaacccaggtggtccagagcagcaggtgcccacagatgaggcggaggcccagatgctgggttctgcagacctggacgacatgaagagtcaccgactggaggacaaccctggtgtgcggcgacacttagtgaaaaagccctcccggacgcagggcgggaggggcagtcccagcggcctggcccccatccttcgcaggaagaagaagaagaaaaagctggaccggaggcctcatgaggtgttcgtggagctgaacgagctgatgctggaccgcagccaggagccccactggcgggagacggcccgctggatcaagtttgaggaggacgtggaggaggagacggagcgctgggggaagccccatgttgcctcgctctccttccgtagccttctggagctcaggaggaccatcgcccatggagctgccctcctggacctggagcaaaccaccctgccaggcattgcacacctcgtggtggagaccatgattgtgtctgaccagatccggccggaggacagggccagcgtcctacgtaccctgctactgaagcacagccatcccaacgatgacaaggacagtggcttctttccccgaaacccatcgagctccagcatgaactcggttctggggaatcatcacccaactcccagccatggccctgatggggcggtgcctaccatggctgatgacctgggggagccagccccactctggccacatgaccctgacgccaaggagaagcccctccacatgcctgggggagatggtcaccgggggaaaagcctgaagctgctggagaagatccctgaagatgctgaggccacggttgtgcttgtgggttgtgtgcctttcttggagcagcctgcagcagccttcgtgcgtctgaatgaggctgtactcctggagtctgtgcttgaggtccctgtcccggtccgcttcctcttcgtgatgctggggcccagccacaccagcactgactatcacgagcttgggcgctccattgccacccttatgtctgacaagctgtttcatgaggctgcctaccaggcagatgaccggcaagacctcctaagtgccatcagcgagttcctggatggcagcattgtgatccccccgtccgaggtggagggccgtgacctgctgcgctccgtggctgctttccagcgagagctgcttaggaagcggcgagagcgtgaacagaccaaagtcgagatgaccacacggggtggctacacggcccctgggaaagaactgtctttggagttggggggctctgaggcgacccctgaagatgaccccttgctgcggacgggctcggtatttggggggcttgtgcgggatgtgaggcgccggtacccgcactaccccagtgacctgcgagatgcgctgcactcccagtgtgtggccgctgtgctcttcatctacttcgcagccctcagccctgccatcaccttcggggggctgctgggagagaagaccgaggggctgatgggcgtgtccgagctgatcgtgtccaccgctgtgctcggcgtcctcttctctctgctgggagctcagccgctgcttgtggttggcttctctgggccgctgcttgtgtttgaggaagccttcttcaagttctgccgagcccaggacctggagtacctcactggccgggtgtgggttggtctctggctggtggtcttcgtccttgccctggtggccgccgaaggcagcttcctggtccgctacatctcgcctttcacccaggagatctttgcctttctcatctcactcattttcatctacgagaccttagggattgacacctgggcctcaggcagagcccagccctgggctggggggctcctcaggacccagagatgtgcctggaaccactcctgatgccatggctagagtggcccccctgacttctgcccggggtgttgacctcgcctcacctttcacagaccagaccggcacaggctttgagctcattataaccacactccttgtctcgtg

SEQ ID NO: 71786 - DNA, 250 bp, Homo sapiens
cctgcgagatgcgctgcactcccagtgtgtggccgctgtgctcttcatctacttcgcagccctcagccctgccatcaccttcggggggctgctgggtaagggactggggcttggggagttgaggggctcctctagtcacttctggtcccagtgtcacttgcaggattctgggtctgggtgtgatcacattagggggccaatggttagatgtgctagcaaaggtgtaagcaccttacagagatgctggatc

SEQ ID NO: 71787 - DNA, 465 bp, Homo sapiens
agcgctcgtggttcatcccacccctgggcagtgcccgtcctttcccgccgtggatgatggtggcagccgctgttcccgccctcctcgtcctcatcctgatcttcatggagacacagatcacggcgtgagagagatgggaggaggaggtgggagggacgaggccaagctccttggctccttggcttggtttcagggttatagcagggacatcattatcagtatcagggtgctgggtggtgggagctggtggcaatccttgaggaagagagtgtgtgtggaggagctggcaggggtgaggaggaggtgggggaggagcagagagcagtggcatccggggcaggggcatggtttccccgtgatggtttgacatgacatctatctgttgccaccactctttgcagggtggcacttgacagtgctcagaacactctagcagtctaagcttgcacccagggatgctcacat

SEQ ID NO: 71788 - DNA, 622 bp, Homo sapiens
  misc_feature (3)..(3): n is a, c, g, or t
  misc_feature (8)..(8): n is a, c, g, or t
ccncgggntgcaggaattcggcacgagaggggtctggggaggtgacatgttgggctgtgggatcccagcgctgggcctgctcctgctgctgcagggctcggcagacggaaatggaatccagggattcttctacccatggagctgtgagggtgacatatgggaccgggagagctgtgggggccaggcggccatcgatagccccaacctctgcctgcgtctccggtgctgctaccgcaatggggtctgctaccaccagcgtccagacgaaaacgtgcggaggaagcacatgtgggcgctggtctggacgtgcagcggcctcctcctcctgagctgcagcatctgcttgttctggtgggccaagcgccgggacgtgctgcatatgcccggtttcctggcgggtccgtgtgacatgtccaagtccgtctcgctgctctccaagcaccgagggaccaagaagacgccgtccacgggcagcgtgccagtcgccctgtccaaagagtccagggatgtggagggaggcaccgagggggaagggacggaggagggtgaggagacagagggcgaggaagaggaggattaggggagtccccgggggactgctcaatacagatacggtggacga

SEQ ID NO: 71789 - DNA, 741 bp, Homo sapiens
gatctacagaaaagttgcagagatagtgtagagaattccctcatcctcctccccagtttcccctattgtaccatctcatattactgtgtttcatttgtcacaactaggaaaccaccgttggtacattctgttaactgagctctggacttagtcggatttcactagtttttcatgtaacgtcctatttctgttccagggtcctatccaggacaccacaggacagttgtcatgccccctcagtcttctctgggctgtgacagtttctgtctttccttgttttccatgaccttgacagtttggagagaagtgctaggcaagtattttgtagactgtgctcagttgaggtttggctcatgtttttctcagggcctagcaccagtgaagaaacgaagaaatttcccagtaaaacaatggggaaaaaatgacccttttcctctcggccctctcaaagggatggaaccattttttggcccagatagcaaaggagcttttcccagcaaaaccagaatgtttccatttggcttttcttggaaacaaaagaggaaaccatgggcagggccgcgagctgggagtagaagctatgggctctctcctgcatccccgcatccccgcccgaccagctgggcatactacaggttgccatcctctctccagagccctgggaacagggcactgtctcattcagatccgcatcaaacctgctctgctcctgggatgataggctggggtggggcagccatc

SEQ ID NO: 71790 - DNA, 1060 bp, Homo sapiens
gctaaatatcaattttgacatgttctaaatataacaattattaatgaaaaatattacattcttttggctttgtactaaacatttgaaatgtggtgtacgtttttcacttatagcacacgcaattcagatgctacatttttattaggaatatttaatctgtagatagatatcgtaaaatttacatttgaaaaaaatagattcagacacctaagttgttacaagcatacttaaaagttttcaatgactgaattgagtatcagttttaaaatttaaaatcaatgaaattaattaaaatgaaatgaaaatttagaaactattcctcagtcacgctggctacatttcaagtgcttcatagccacatgaaagctgtattggacagcaaagaagtagaatatatttggaataaaaattttaaagtggacacattgtgttactctcgttagccatgctattgctattttttttcctatagctaattaaaaccttaagatccagtaggttctccacctttttttaaagcattagttccatgtcgaccctgtagatggcagcactttcttcctaaaactacatggagggagttgcctgggcttgtcactcagattctggcacttttcatagaaagagtctgaattatctggaaaattctttggtaacataggtcagaatcttttcagctctattgttattctgcacagatggctgttgcttatgaaaacaatctctcagcctctagtccaggatattactcattcctcagttcaagaaactctagggtgagaggagaaaggggttcaattacagaactgttatcaaaatgcgttggtttatgcacatccgtgttttggacatggtgattccaagagactcttaataaaacttttcaaagtagatgagagacagtttttccctcacatgctgtggcaatattaatctatgttttcatgttccactggactttgtaattgaattttaaggaatgcatacagggcttcatatttatatataaaatatccatatccagtgttgaaagaaattaacaataaaatatgtacctgta

SEQ ID NO: 71791 - DNA, 358 bp, Homo sapiens
tcaagcttaaaatgaatttaatatctttagaaagagggaaagtgaaatcatcaaaacagcctaaataaacttaaaaactcttctttacagaaaggctattttaaacccaaacaagctcataacaagaacaatggattgtaagttctaacactctcagactgaaggctgaactggaaagaccagctgctaacagcggctgctgtagttccaggtgaggggcaggacactggaatattccttatgtgactatagtatgggtgcaagagacacacacatatatatatatacacacactgttgcttactttttggctggagaataaagctcaggaaaaaagagccaaaaccatgcagacatg

SEQ ID NO: 71792 - DNA, 1284 bp, Homo sapiens
ggcacgagggccggaaggcggcgtccgcgacgcagctgttcacgcttaggtgggcgacgtgggcgcaggtgggcgcaggatggcaaaacagaagagaaaagttcctgaagtgacagagaaaaagaacaaaaagctgaagaaggcgtcagcagaggggccactgctgggccctgaggctgcaccaagtggcgaaggagccggctccaagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcag

SEQ ID NO: 71793 - DNA, 315 bp, Homo sapiens
ggagtattaaaagtgcccgcacttgaaatcttactgcgtgtcctgaagagagccctgtccctttcccatgagatgctgagccgtgatctgtactcgggaagcacacagatctcctgtctccaccctggcgtgttctgacaggtgcagccgctgtgtcaccagcaccccggcaagggagaccgcctccgtcgcccctccctggcccacgccctcccagacccggccctcgtcgccgctgtgtcgctggtgaggtgggttccctgctctggagctgctgaagaggctccagtactttgcacgtgctcacatctagct

SEQ ID NO: 71794 - DNA, 1200 bp, Homo sapiens
tataggtaggaggcctgggtggccgagtgaggctgctggaggcgcgggccgggcggtgcgcactgcgggcgcatccctgccccggcgccgtccgtgcccgcgggacctgacagccgggtcagagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcag

SEQ ID NO: 71795 - DNA, 1275 bp, Homo sapiens
cgctggcgtcacggtccagccggctggatctggttccagccgcgccgggccggccgggcatgggcagtgtggaggcgctgaggctgctggaggcgcgggccgggcggtgcgcactgcgggcgcatccctgccccggcgccgtccgtgcccgcgggacctgacagccgggtcagagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcagaaaacacaacaacaaaacaaaaaa

SEQ ID NO: 71796 - DNA, 1264 bp, Homo sapiens
ggcacgagggccggaaggcggcgtccgcgacgcagctgttcacgcttaggtgggcgacgatggcaaaacagaagagaaaagttcctgaagtgacagagaaaaagaacaaaaagctgaagaaggcgtcagcagaggggccactgctgggccctgaggctgcaccaagtggcgaaggagccggctccaagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcag

SEQ ID NO: 71797 - DNA, 1374 bp, Homo sapiens
cgctggcgtcacggtccagccggctggatctggttccagccgcgccgggccggccgggcatgggcagtgtggaggcgctgaggctgctggaggcgcgggccgggcggtgcgcactgcgggcgcatccctgccccggcgccgtccgtgcccgcgggacctgacagccgggtcagagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcagaagagagcggggtctggccgggaaacaaaccacaacaaacaagaacaacggaacacagacagcagcgagaaaaaagagcgcccagaaacagccacgcttcgctcccggagacacacgggcatg

SEQ ID NO: 71798 - DNA, 1273 bp, Homo sapiens
ggcccggcgcggcgcgaccgggcggcggccctggggtccgcggtgctggggaggctggtgcggccgggatggcaaaacagaagagaaaagttcctgaagtgacagagaaaaagaacaaaaagctgaagaaggcgtcagcagaggggccactgctgggccctgaggctgcaccaagtggcgaaggagccggctccaagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcag

SEQ ID NO: 71799 - DNA, 1327 bp, Homo sapiens
ggagtattaaaagtgcccgcacttgaaatcttactgcgtgtcctgaagagagccctgtccctttcccatgagatgctgagccgtgatctgtactcgggaagcacacagatctcctgtctccaccctggcgtgttctgacaggtgcagccgctgtgtcaccagcaccccggcaagggagaccgcctccgtcgcccctccctggcccacgccctcccagacccggccctcgtcgccgctgtgtcgctggtgagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcag

SEQ ID NO: 71800 - DNA, 1391 bp, Homo sapiens
aataattcgaaggacgacgtcggcaacccacttgttaaccctaagggggccaacggggccgcaggtggtcccagatggcaaaacagaagagaaaagttcctgaagtgacagagaaaaagaacaaaaagctgaagaaggcgtcagcagaggggccactgctgggccctgaggctgcaccaagtggcgaaggagccggctccaagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcaggtgagcggccctgccccacgcggttctgtcccggacgtgcgtctcaacccctgcctgagggggtcgaagccttcactcgcacacactgtgtggaaggttctagagcagtgagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcag

SEQ ID NO: 71801 - DNA, 1197 bp, Homo sapiens
cgctggcgtcacggtccagccggctggatctggttccagccgcgccgggccggccgggcatgggcagtgtggaggcgctgaggctgctggaggcgcgggccgggcggtgcgcactgcgggcgcatccctgccccggcgccgtccgtgcccgcgggacctgacagccgggtcagagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcag

SEQ ID NO: 71802 - DNA, 782 bp, Homo sapiens
aaggcttatgagtgggaaatcctggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcag

SEQ ID NO: 71803 - DNA, 1132 bp, Homo sapiens
cgctggcgtcacggtccagccggctggatctggttccagccgcgccgggccggccgggcatgggcagtgtggaggcgctgaggctgctggaggcgcgggccgggcggtgcgcactgcgggcgcatccctgccccggcgccgtccgtgcccgcgggacctgacagccgggtcagagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggatgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcag

SEQ ID NO: 71804 - DNA, 1083 bp, Homo sapiens
aaaggctaggtacgagggctgggttgtggtgaggctgctggaggcgcgggccgggcggtgcgcactgcgggcgcatccctgccccggcgccgtccgtgcccgcgggacctgacagccgggtcagagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggatgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcag

SEQ ID NO: 71805 - DNA, 1038 bp, Homo sapiens
cgctggcgtcacggtccagccggctggatctggttccagccgcgccgggccggccgggcatgggcagtgtggaggcgctgaggctgctggaggcgcgggccgggcggtgcgcactgcgggcgcatccctgccccggcgccgtccgtgcccgcgggacctgacagccgggtcagagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggcctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcag

SEQ ID NO: 71806 - DNA, 1600 bp, Homo sapiens
  misc_feature (1316)..(1316): n is a, c, g, or t
ggcacgagggccggaaggcggcgtccgcgacgcagctgttcacgcttaggtgggcgacgtgggcgcaggtgggcgcaggatggcaaaacagaagagaaaagttcctgaagtgacagagaaaaagaacaaaaagctgaagaaggcgtcagcagaggggccactgctgggccctgaggctgcaccaagtggcgaaggagccggctccaagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcagaaaaaaaaaaaaaaaaaaaaaaaaattcgggaaaaagttctccctctcttccccggggacngccctgggggcctgggggggccccaggggcccgggggggttgcgctgggagcgcggagagacacttggagccgcggcgagggggagagtacacgggatcgaccgcccccggatgtgggggggctccccgaaaaacatcggggagaggcccttttccgggaaagatggaacgacaagagaacccccagtggggattccccccaaagaaaaccccagggcgtgcggggaagaaacttggacctaggcaaaagtgcgtctttggaggcgaaaaattgggcacccgga

SEQ ID NO: 71807 - DNA, 977 bp, Homo sapiens
ggcacgagggccggaaggcggcgtccgcgacgcagctgttcacgcttaggtgggcgacgtgggcgcaggtgggcgcaggatggcaaaacagaagagaaaagttcctgaagtgacagagaaaaagaacaaaaagctgaagaaggcgtcagcagaggggccactgctgggccctgaggctgcaccaagtggcgaaggagccggctccaagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagccctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcag

SEQ ID NO: 71808 - DNA, 961 bp, Homo sapiens
cgctggcgtcacggtccagccggctggatctggttccagccgcgccgggccggccgggcatgggcagtgtggaggcgctgaggctgctggaggcgcgggccgggcggtgcgcactgcgggcgcatccctgccccggcgccgtccgtgcccgcgggacctgacagccgggtcagagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcag

SEQ ID NO: 71809 - DNA, 464 bp, Homo sapiens
aataattcgaaggacgacgtcggcaacccacttgttaaccctaagggggccaacggggccgcaggtggtcccagatggcaaaacagaagagaaaagttcctgaagtgacagagaaaaagaacaaaaagctgaagaaggcgtcagcagaggggccactgctgggccctgaggctgcaccaagtggcgaaggagccggctccaagggcgaagctgtgctcaggcccgggctggacgcagagccagagctgtccccagaggagccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcag

SEQ ID NO: 71810 - DNA, 933 bp, Homo sapiens
aaaggctaggtacgagggctgggttgtggtgaggctgctggaggcgcgggccgggcggtgcgcactgcgggcgcatccctgccccggcgccgtccgtgcccgcgggacctgacagccgggtcagaggctcctgcacggcgggtgctgtgtctccgggcccaggtgacctcggggtgagaaggaaggggcctctgagatgagaacatagttttgctgttttcagtttatactcaaagccctgcagtttcctgacagcacagagcacacctgtcacgcgagcaggatgaagcccagaggctgcctggtgaagtgggcggcgcgctggaaaatccacgtagctttgttccctccacggggagcgtgcaaggccctctcgagcactacgggagcctcgccttctgcacagacttcggagccaggtgctggagcggcagcaactgaggggcgtggatgtctttgcatggttcccatacgttttttaaacgttaataatgtgattttcagtaaagtggcaggatcagcattgaagaatggggagcaactgtgagccgatttcctgcgagtggttgagaagcaggctttgtgtggttggccgtccttgtgcttagcggctgctcctgccggagctgcctgcctgtcttagaaacaacgccgcctccgactgctagttagcggtggcttccacaggtgaagcccaggcaggttagtgttctcacagctaggaaggacacgggcctggcagggagctgcagcacagcctctgtcgacacagaagcactgccgtgcgaacccttgcctcccgggacagctgttgcgcgcccagcagctggagcgctggctctgcgagggctcttcagcaatgccaggtgcagctgggctccaccctcaactggtccaatagtagcgaaagaaacgaggagtgtcgtgaatcgt

SEQ ID NO: 71811 - DNA, 527 bp, Homo sapiens
aaaggctaggtacgagggctgggttgtggtgaggctgctggaggcgcgggccgggcggtgcgcactgcgggcgcatccctgccccggcgccgtccgtgcccgcgggacctgacagccgggtcagaggctcctgcacggcgggtgctgtgtctccgggcccaggtgacctcggggtgagaaggaaggggcctctgagatgagaacatagttttgctgttttcagtttatactcaaagccctgcagtttcctgacagcacagagcacacctgtcacgcgagcaggatgaagcccagaggctgcctggtgaagtgggcggcgcgctggaaaatccacgtagctttgttccctccacggggagcgtgcaaggccctctcgagcactacgggagcctcgccttctgcacagacttcggagccaggtgctggagcggcagcaactgaggggcgtggatgtctttgcatggttcccatacgttttttaaacgttaataatgtgattttcagtaaagtggcaggatcagcattga

SEQ ID NO: 71812 - DNA, 1251 bp, Homo sapiens
cgctggcgtcacggtccagccggctggatctggttccagccgcgccgggccggccgggcatgggcagtgtggaggcgctgaggctgctggaggcgcgggccgggcggtgcgcactgcgggcgcatccctgccccggcgccgtccgtgcccgcgggacctgacagccgggtcagagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcag

SEQ ID NO: 71813 - DNA, 1616 bp, Homo sapiens
  misc_feature (1332)..(1332): n is a, c, g, or t
cgctggcgtcacggtccagccggctggatctggttccagccgcgccgggccggccgggcatgggcagtgtggaggcgctgaggctgctggaggcgcgggccgggcggtgcgcactgcgggcgcatccctgccccggcgccgtccgtgcccgcgggacctgacagccgggtcagagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcagaaaaaaaaaaaaaaaaaaaaaaaaaaaaaaaaaaaaaaaaaaaaattcgggaaaaagttctccctctcttccccggggacngccctgggggcctgggggggccccaggggcccgggggggttgcgctgggagcgcggagagacacttggagccgcggcgagggggagagtacacgggatcgaccgcccccggatgtgggggggctccccgaaaaacatcggggagaggcccttttccgggaaagatggaacgacaagagaacccccagtggggattccccccaaagaaaaccccagggcgtgcggggaagaaacttggacctaggcaaaagtgcgtctttggaggcgaaaaattgggcacccgga

SEQ ID NO: 71814 - DNA, 1279 bp, Homo sapiens
aataattcgaaggacgacgtcggcaacccacttgttaaccctaagggggccaacggggccgcaggtggtcccagatggcaaaacagaagagaaaagttcctgaagtgacagagaaaaagaacaaaaagctgaagaaggcgtcagcagaggggccactgctgggccctgaggctgcaccaagtggcgaaggagccggctccaagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcag

SEQ ID NO: 71815 - DNA, 1273 bp, Homo sapiens
cgctggcgtcacggtccagccggctggatctggttccagccgcgccgggccggccgggcatgggcagtgtggaggcgctgaggctgctggaggcgcgggccgggcggtgcgcactgcgggcgcatccctgccccggcgccgtccgtgcccgcgggacctgacagccgggtcagagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcaggggtcctgctctgtacggtgcg

SEQ ID NO: 71816 - DNA, 1347 bp, Homo sapiens
ggtggaccacgggggtggggaaggggcctctgggcagttaatcctggcacctggcgcctgcccgcaggactggccatcctcatgtgacctgtctgtctcttcgtcgtagcacaggcttagcaggatggtgtcggctggggccagacccagtgcttggggacagagcttttggccactactgaggtgagggtgggctcgggaagccccaggcagcgcacccgtctctggataccctccatccccgaagcctaatgtgttccttgactttcagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcag

SEQ ID NO: 71817 - DNA, 1245 bp, Homo sapiens
aataattcgaaggacgacgtcggcaacccacttgttaaccctaagggggccaacggggccgcaggtggtcccagatggcaaaacagaagagaaaagttcctgaagtgacagagaaaaagaacaaaaagctgaagaaggcgtcagcagaggggccactgctgggccctgaggctgcaccaagtggcgaaggagccggctccaagggcgaagctgtgctcaggcccgggagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcag

SEQ ID NO: 71818 - DNA, 1184 bp, Homo sapiens
gcgagcggcacagattgccaatgccaagcagagcggttagactaggtagtagattccatggatgcattagataaagttgtccaggaaagagaagatgccctaaggcttcttcagactggtcaagaaagagctagacctggtgcttggagaagagacatctttggaagaatcatctggcacaagttcaagcagtgggttataccttggcacctaaataaaagatacaataggaaacgattcttggccttgccatatgcaattgcatatggcaaggccaagagcgggacggctcatcttcggtgatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcag

SEQ ID NO: 71819 - DNA, 1125 bp, Homo sapiens
aaaggctaggtacgagggctgggttgtggtgaggctgctggaggcgcgggccgggcggtgcgcactgcgggcgcatccctgccccggcgccgtccgtgcccgcgggacctgacagccgggtcagaggctctgatccccccctgcctggggagggcccagcgcatcctgacaggtgctgcagctgctctcctagtgggttcagcgcggggcggggccgctgcccagtgcagggctgcctcagaccacacagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggaggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcag

SEQ ID NO: 71820 - DNA, 1087 bp, Homo sapiens
ggcacgagggccggaaggcggcgtccgcgacgcagctgttcacgcttaggtgggcgacgtgggcgcaggtgggcgcaggatggcaaaacagaagagaaaagttcctgaagtgacagagaaaaagaacaaaaagctgaagaaggcgtcagcagaggggccactgctgggccctgaggctgcaccaagtggcgaaggagccggctccaagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcaggcctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcag

SEQ ID NO: 71821 - DNA, 899 bp, Homo sapiens
cgctggcgtcacggtccagccggctggatctggttccagccgcgccgggccggccgggcatgggcagtgtggaggcgctgaggctgctggaggcgcgggccgggcggtgcgcactgcgggcgcatccctgccccggcgccgtccgtgcccgcgggacctgacagccgggtcagagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggtgctgcagctgctctcctagtgggttcagcgcggggcggggccgctgcccagtgcagggctgccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcaggggtcctgctctgtacggtgcg

SEQ ID NO: 71822 - DNA, 1152 bp, Homo sapiens
aaaggctaggtacgagggctgggttgtggtgaggctgctggaggcgcgggccgggcggtgcgcactgcgggcgcatccctgccccggcgccgtccgtgcccgcgggacctgacagccgggtcagagggcgaagctgtgctcaggcccgggctggacgcagagccagagctgtccccagaggagcggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcagggccttgtggcccagcacccgcctgcaggcgctcgggggccgaactggccctggactacctctgcagcatgggccaaaaggcacaagactggaggtttcagcaggacgaggcagacgtgggatcctgctgcacatgtattaccagtgacaagggtcccgatgagcacttctcaacctggtggctactggagggctgcaggccggccgagaagtgacggtcagaaggcggagcccgatgcggactgataagagggctgaatccacctgtcgggagggccagggactcgaaacgtgcgggcgcgtgaagacgtgcaccctttcggcgaattccggaacccggtgggtgcggcatccggtgccccacgtggcaacgaggggccggggtcgcggttactttgccccccagggtttttggtttggagggccccgtgggagatggcaaacaccactgacaaagccgtggtgctaataccgcccgagagaacgaaagcaaagagagtcgtggtgacgacctggcgcatcctttatgtacaggctcagggggtgtctcacgcgagt

SEQ ID NO: 71823 - DNA, 2768 bp, Homo sapiens
  misc_feature (238)..(238): n is a, c, g, or t
gggtctgtgtgcccctccgcactggctactgtcttcctcgggcgccggtcggcttttgcgtccccacattcaatcccaactgcggctcccgcggttcccgcactggccgcagaggagccacggggcacagctggctgtgtttagggccctgcacagccccacagccagtcgctccccccacagttccgaaagaatatggccccccagaggaaggacctgcatggactgtcattctccnttcttcgagcacagaaccgcgacaagctgttcaaagtctctgtcccccacgtcctggagatgcggaagcgggagctgaggcccaggtgggtccaggaggggctgccccacctgcttccctccaggcccctctggtgggacccactgtggcccctgtagagtcccctccctacagattgcccggaatgacccatgtggctggaaggactgatgccttcagacacagctggatccaggtgctgccttcctgggacctacccaccccatttccccaggcctgacacccctgcacacagcctcaatccacgggtggggagcaaagccaccaccccccacccagccccccgggtgcagaatgagccctgggaaagctctaatgggtgcctgtggccccgggaaggaacatggctctctagccaggggccaaaggcacctgccccaacccctagcctccagccaccagctgacgaggacctgaagtgagtgatgagacccccacaggagccagagaagggtggaaaagccagtttgtcagacacaactgggacagccacagcttgggaccctgggaccctgggaccctgaggcagagccgcaggggtccggcctgggccgatggtgggtgggggcaaggcgggagcgcaagcctctgacttccttctagttccgacgagtaccaggccgcccgagccaccctgctcagagcgttccaggcgaagtttgacacatttgtagttccctgtgttgttgccagtggcgacatcaaagacaggaaggggtcagaacccctgagcttcaggtgcggggtgctctggccagaacagggtgtggtcagccgcaaacgcgctgtccctctgctactgcccaactctggggcctgggcgggcagggggccgcccaccctgccctcagcatgcccttcctatcccagcccccacaacaccctgtacctggagctgtggtgcccgacggtggcaccatctgttgtggtgacgtcccataaaggcaagaccatctttaacttcggcgacgtcgctgtggggcaccgcagtatcaagaagatctccatccagaacgtctctcccgaggatctggccctggacttctccctgctgaaccccaacggcccctttgtcctgctgaaccactccagcctgctgcgtgcaggtgggacccaggtcctggtgctttccttctctccccacgagagcatcctggctcaagaaacactggacatcatcaccaagagaggcacgctcaccctcaccctcatgggcactggcgtggcgtccatgatcacgtgctccattgaaggcagcgtcctcaacatgggctatgtgattgccggagagtctgtgtcctcaggcttcaagctgcagaacaactctctgctccccatcaagttctccatgcacctggacagcctctccagcacccggggccggggccagcagcagctgccgcagttcctcagctcgccctcccagaggacggaggtggtcgggacgcagaatctcaacggtcagagcgtgttcagcgtggcccccgtcaagggcgtcatggaccccgggaagacacaagacttcactgtcaccttcagccccgaccacgaaagcctctacttctccgacaagctccaggtggtgctctttgaaaagaaaatctcccaccagatcctgctgaagggtgccgcctgtcagcacatgatgttcgtggagggcggcgaccccctggacgtgcccgtggagtctctgacagcgatccctgtatttgaccccaggcacagagaggccagctcccggccaggccctctctctccagaagctgaggagctgaggcccatcctggtgaccctggactacatccagtttgacacagacacgccagccccacctgccacccgagagctgcaggtgggctgtatccggaccacccagccatctccaaagaagaccgttgagttcagcatagacagcgtcgcatccctgcagcacaagggtttctctattgagccctccaggggctccgtggagcgcggccagacgaagaccatcagcatctcctgggtgccacctgcggactttgatccagaccacccactcatggtgtcggccctgctgcagctaaggggggatgtgaaggagacctacaaggtcatctttgtagcccaggtgttgactggcccctaagcctctgcacagagcaccctcgggccctcctgtccaccctcaaagccctccccaggctgagggccaggtcatactaccctagagcctgggacctggccatcctctgccagtcagattccaataggccgccctccacatggcgccacggccacttcctgctgccctggaccccgcaagcccagggacatccaagagcacccctcctgagaccccagactcagaagcagcgagaaggccaggccagccctcagccatcctagccagaccccctcagagcccccagcccccaggagagccctccacagcctgtcaataaattttttgtaggccaacacatgcagc

SEQ ID NO: 71824 - DNA, 1731 bp, Homo sapiens
  misc_feature (238)..(238): n is a, c, g, or t
gggtctgtgtgcccctccgcactggctactgtcttcctcgggcgccggtcggcttttgcgtccccacattcaatcccaactgcggctcccgcggttcccgcactggccgcagaggagccacggggcacagctggctgtgtttagggccctgcacagccccacagccagtcgctccccccacagttccgaaagaatatggccccccagaggaaggacctgcatggactgtcattctccnttcttcgagcacagaaccgcgacaagctgttcaaagtctctgtcccccacgtcctggagatgcggaagcgggagctgaggcccaggtgggtccaggaggggctgccccacctgcttccctccaggcccctctggtgggacccactgtggcccctgtagagtcccctccctacagattgcccggaatgacccatgtggctggaaggactgatgccttcagacacagctggatccaggtgctgccttcctgggacctacccaccccatttccccaggcctgacacccctgcacacagcctcaatccacgggtggggagcaaagccaccaccccccacccagccccccgggtgcagaatgagccctgggaaagctctaatgggtgcctgtggccccgggaaggaacatggctctctagccaggggccaaaggcacctgccccaacccctagcctccagccaccagctgacgaggacctgaagtgagtgatgagacccccacaggagccagagaagggtggaaaagccagtttgtcagacacaactgggacagccacagcttgggaccctgggaccctgggaccctgaggcagagccgcaggggtccggcctgggccgatggtgggtgggggcaaggcgggagcgcaagcctctgacttccttctagttccgacgagtaccaggccgcccgagccaccctgctcagagcgttccaggcgaagtttgacacatttgtagttccctgtgttgttgccagtggcgacatcaaagacaggaaggggtcagaacccctgagcttcagcccccacaacaccctgtacctggagctgtggtgcccgacggtggcaccatctgttgtggtgacgtcccataaaggcaagaccatctttaacttcggcgacgtcgctgtggggcaccgcagtatcaagaagatctccatccagaacgtctctcccgaggatctggccctggacttctccctgctgaaccccaacggcccctttgtcctgctgaaccactccagcctgctgcgtgcaggtgggacccaggtcctggtgctttccttctctccccacgagagcatcctggctcaagaaacactggacatcatcaccaagagaggcacgctcaccctcaccctcatgggcactggcgtggcgtccatgatcacgtgctccattgaaggcagcgtcctcaacatgggctatgtgattgccggagagtctgtgtcctcaggcttcaaggtgaagcacacgtgggccctggtgctggctccagcctcccaggaggggtttccaccaggcaggactcaggccagctgtcaaaagtgacccgtgggtcggagagcccgtggggacacaggtggccccctctacccctcctctacacagctgccgcctctgccgccctctcctgcagggaacccggggcctgtttctggggaggctgcagatgtcccctagtcctccccacctccctgtcctccttggcgctctt

SEQ ID NO: 71825 - DNA, 287 bp, Homo sapiens
agttcggcactaggcctcgctacaccaacaaatctaagccctccctagctgcttggtaactgtgtcatgaagctgccggacagacacacgtggcatctccctgggcaggagagcaggcctgcagcatgggtcctgttcccgtgtgccgtgggtggcagtggctgcacctggcactagggctgctctgtggatgtgggtgacaacggcaggaggggatgctggccttcctgcacatagacctgcagttagtaaatcataagcccaaataaacaggttgtttgaatata

SEQ ID NO: 71826 - DNA, 191 bp, Homo sapiens
aattcaagcttctaacgatgtacggggacatgggtcctgttcccgtgtgccgtgggtggcagtggctgcacctggcactagggctgctctgtggatgtgggtgacaacggcaggaggggatgctggccttcctgcacatagacctgcagttagtaaatcataagcccaaataaacaggttgtttgaatata

SEQ ID NO: 71827 - DNA, 520 bp, Homo sapiens
ggagtatagggcttgaactgagagcctggcctcccagaaggttttaatagacctacggcacagaaattgacacagcccgtaagttcatgggaggggcctgagaggagacgggtgagacagacgcgtccgagcaggttgggagaaagggcttctctgcgaggcttctctgccaggtcactgtgccacgtgggttacggaactctccttggtgtagggctcaacagggtggagccacgagtccatgagctcttcgtacttgcacagccctaggcctggcatggagtggccagggcgaggctggttctgctgtccgctctccccagggtcccgccacgagggtggcgtggcatggggcacatcgcccggacttcctgtccctcttgggtttaggaatgggatggtgaggcctccctggcagcttgttaggaggagtaaaccaagcgagccgaccagctcccagcagggtcccggcacacagtaggtgctcagcaaacgaagctgtgacctgagggtggagagt

SEQ ID NO: 71828 - DNA, 1916 bp, Homo sapiens
ttttttcttccggtggctggtctccggcggccccgtccccgactgggccccgtgcccccccgcccccgcggccccccgccgccgggccagccgccaccatgaagaaattctttcaggagttcaaggccgacatcaagttcaagagcgcgggacccggtcagaagctcaaagagtccgtgggggaaaaggcccacaaagagaagcccaaccagccagcccccaggccgccccgccagggacccaccaatgaggcacagatggcagccgctgctgccctagcccggctggagcagaagcagtcccgggcctggggccccacatcgcaggacaccatccgaaaccaggtgagaaaggaacttcaagccgaagccaccgtcagcgggagccccgaggccccagggaccaacgtggtatctgagcccagagaggaaggctctgcccacctggctgtgcctggcgtgtacttcacctgtccgctcactggggccaccctgaggaaggaccagcgggacgcctgcatcaaggaggccattctcttgcacttctccaccgacccagtggccgcctccatcatgaagatctacacgttcaacaaagaccaggaccgggtgaagctgggtgtggacaccattgccaagtacctggacaacatccacctgcaccccgaggaggagaagtaccggaagatcaagctgcagaacaaggtgtttcaggagcgcattaactgcctggaagggacccacgagttttttgaggccattgggttccagaaggtgttgcttcccgcccaggatcaggaggaccccgaggagttctacgtgctgagcgagaccaccttggcccagccccagagcctggagaggcacaaggaacagctgctggctgcggagcccgtgcgcgccaagctggacaggcagcgccgcgtcttccagccctcgcccctggcctcgcagttcgaactgcctggggacttcttcaacctcacagcagaggagatcaagcgggagcagaggctcaggtccgaggcggtggagcggctgagcgtgctgcggaccaaggccatgcgggagaaggaggagcagcgggggctgcgcaagtacaactacacgctgctgcgcgtgcgcctccccgatggctgcctcctgcagggcactttctacgctcgggagcggctgggggcggtgtacgggttcgtccgggaggccctgcagagcgactggctgccttttgagctgctggcctcgggagggcagaagctgtccgaggacgagaacctggccttgaacgagtgcgggctggtgccctctgccctcctgaccttctcgtgggacatggctgtgctggaggacatcaaggccgcgggggccgagccggactccatcctgaaacccgagctcctgtcagccatcgagaagctcttgtgaaataaaagcagggttggcctcagccctgtgggtctgtctcatgctctccctgttcctctccccgccaccccagggcctccaagccacctctggaaatacttggctctgccccatgggcacgggaggggcgccagccgtggagctgtggaattgggccccgtggcagagcccccatcccttgggggctgtggggatgcgcccaagcccccgagggagaggcctggggacaccaacaaatctaagccctccctagctgcttggtaactgtgtcatgaagctgccggacagacacacgtggcatctccctgggcaggagagcaggcctgcagcatgggtcctgttcccgtgtgccgtgggtggcagtggctgcacctggcactagggctgctctgtggatgtgggtgacaacggcaggaggggatgctggccttcctgcacatagacctgcagttagtaaatcataagcccaaataaacaggttgtttgaatata

SEQ ID NO: 71829 - DNA, 1987 bp, Homo sapiens
gggcaggacttgcccgatggtgcagagctgagtggaaccagcatctccttcctccaggggctcttccgcctgcagtagaaccatctggtggctgcaggtggcccctgggaaccaggtgtcctggcccacataggcagggacacgtctggctgatggtgctggggaggggcagaagctcctctgtgtgactgcacgtcagctttgccggccacctcgggaggatacactcactctccctcggtctgttcccagggaaaaggcccacaaagagaagcccaaccagccagcccccaggccgccccgccagggacccaccaatgaggcacagatggcagccgctgctgccctagcccggctggagcagaagcagtcccgggcctggggccccacatcgcaggacaccatccgaaaccaggtgagaaaggaacttcaagccgaagccaccgtcagcgggagccccgaggccccagggaccaacgtggtatctgagcccagagaggaaggctctgcccacctggctgtgcctggcgtgtacttcacctgtccgctcactggggccaccctgaggaaggaccagcgggacgcctgcatcaaggaggccattctcttgcacttctccaccgacccagtggccgcctccatcatgaagatctacacgttcaacaaagaccaggaccgggtgaagctgggtgtggacaccattgccaagtacctggacaacatccacctgcaccccgaggaggagaagtaccggaagatcaagctgcagaacaaggtgtttcaggagcgcattaactgcctggaagggacccacgagttttttgaggccattgggttccagaaggtgttgcttcccgcccaggatcaggaggaccccgaggagttctacgtgctgagcgagaccaccttggcccagccccagagcctggagaggcacaaggaacagctgctggctgcggagcccgtgcgcgccaagctggacaggcagcgccgcgtcttccagccctcgcccctggcctcgcagttcgaactgcctggggacttcttcaacctcacagcagaggagatcaagcgggagcagaggctcaggtccgaggcggtggagcggctgagcgtgctgcggaccaaggccatgcgggagaaggaggagcagcgggggctgcgcaagtacaactacacgctgctgcgcgtgcgcctccccgatggctgcctcctgcagggcactttctacgctcgggagcggctgggggcggtgtacgggttcgtccgggaggccctgcagagcgactggctgccttttgagctgctggcctcgggagggcagaagctgtccgaggacgagaacctggccttgaacgagtgcgggctggtgccctctgccctcctgaccttctcgtgggacatggctgtgctggaggacatcaaggccgcgggggccgagccggactccatcctgaaacccgagctcctgtcagccatcgagaagctcttgtgaaataaaagcagggttggcctcagccctgtgggtctgtctcatgctctccctgttcctctccccgccaccccagggcctccaagccacctctggaaatacttggctctgccccatgggcacgggaggggcgccagccgtggagctgtggaattgggccccgtggcagagcccccatcccttgggggctgtggggatgcgcccaagcccccgagggagaggcctggggacaccaacaaatctaagccctccctagctgcttggtaactgtgtcatgaagctgccggacagacacacgtggcatctccctgggcaggagagcaggcctgcagcatgggtcctgttcccgtgtgccgtgggtggcagtggctgcacctggcactagggctgctctgtggatgtgggtgacaacggcaggaggggatgctggccttcctgcacatagacctgcagttagtaaatcataagcccaaataaacaggttgtttgaatata

SEQ ID NO: 71830 - DNA, 2228 bp, Homo sapiens
cacccgccctcatctgggcagcccagggaggtgcgggtggcagccctgcttcccaggccatgggtggctctctgggtgtggccgtgtgtgatggctgtgccgagcgtggatttgtgccccaatcttttccaggtcttagggtacgtactgttctcagcctctccatgctgggacgctgttcgcagtcagcagggctggttctgggaaacccccagagttccagctatgacttctcccctcccccggtaacataggtggataggtgggacctcggggaggggcaggggctgggggtatccgtcttccagctattgagtttcagacattgagggttgcagactcatttgtgtcctctctgccacctgccatccctgtgaccctggacgatgggcctctcggtctctttgtaaacatgaggcccgggagtggttccagaacgtccatcatggggctgcgagagcaggagggatggggcgtccatggtggcgggaggttctgtaagtggcggtggccttgatggatctcagcactgaggtcgagttctaaagccagagtgtgaggcacagttctgtcgcgtcacactggcttccaagtcccatggatctagccttgagaaggcggaaggggagacttgagttctgctgggtcttggctgcgtcgcctctgccctggggcgtgggcagggctgcggtcttggagggtctctcttttcctttctgtgatgagcgcacagctggggccgctccaagccgctgttctgccttccttttcctgcccctgttacctgggcagcggagggccgtgcggcccgggctctcagtgagtggctttccctgcttccctcctcccagcacttctccaccgacccagtggccgcctccatcatgaagatctacacgttcaacaaagaccaggaccgggtgaagctgggtgtggacaccattgccaagtacctggacaacatccacctgcaccccgaggaggagaagtaccggaagatcaagctgcagaacaaggtgtttcaggagcgcattaactgcctggaagggacccacgagttttttgaggccattgggttccagaaggtgttgcttcccgcccaggatcaggaggaccccgaggagttctacgtgctgagcgagaccaccttggcccagccccagagcctggagaggcacaaggaacagctgctggctgcggagcccgtgcgcgccaagctggacaggcagcgccgcgtcttccagccctcgcccctggcctcgcagttcgaactgcctggggacttcttcaacctcacagcagaggagatcaagcgggagcagaggctcaggtccgaggcggtggagcggctgagcgtgctgcggaccaaggccatgcgggagaaggaggagcagcgggggctgcgcaagtacaactacacgctgctgcgcgtgcgcctccccgatggctgcctcctgcagggcactttctacgctcgggagcggctgggggcggtgtacgggttcgtccgggaggccctgcagagcgactggctgccttttgagctgctggcctcgggagggcagaagctgtccgaggacgagaacctggccttgaacgagtgcgggctggtgccctctgccctcctgaccttctcgtgggacatggctgtgctggaggacatcaaggccgcgggggccgagccggactccatcctgaaacccgagctcctgtcagccatcgagaagctcttgtgaaataaaagcagggttggcctcagccctgtgggtctgtctcatgctctccctgttcctctccccgccaccccagggcctccaagccacctctggaaatacttggctctgccccatgggcacgggaggggcgccagccgtggagctgtggaattgggccccgtggcagagcccccatcccttgggggctgtggggatgcgcccaagcccccgagggagaggcctggggacaccaacaaatctaagccctccctagctgcttggtaactgtgtcatgaagctgccggacagacacacgtggcatctccctgggcaggagagcaggcctgcagcatgggtcctgttcccgtgtgccgtgggtggcagtggctgcacctggcactagggctgctctgtggatgtgggtgacaacggcaggaggggatgctggccttcctgcacatagacctgcagttagtaaatcataagcccaaataaacaggttgtttgaatata

SEQ ID NO: 71831 - DNA, 2608 bp, Homo sapiens
ttttttcttccggtggctggtctccggcggccccgtccccgactgggccccgtgcccccccgcccccgcggccccccgccgccgggccagccgccaccatgaagaaattctttcaggagttcaaggccgacatcaagttcaagagcgcgggacccggtcagaagctcaaagagtccgtgggggaaaaggcccacaaagagaagcccaaccagccagcccccaggccgccccgccagggacccaccaatgaggcacagatggcagccgctgctgccctagcccggctggagcagaagcagtcccgggcctggggccccacatcgcaggacaccatccgaaaccaggtgagaaaggaacttcaagccgaagccaccgtcagcgggagccccgaggccccagggaccaacgtggtatctgagcccagagaggaaggctctgcccacctggctgtgcctggcgtgtacttcacctgtccgctcactggggccaccctgaggaaggaccagcgggacgcctgcatcaaggaggccattctcttgcacttctccaccgacccagtggccgcctccatcatgaagatctacacgttcaacaaagaccaggaccgggtgaagctgggtgtggacaccattgccaagtgagcgtgtggcccctttgccctgcctggcccctccagctcatcccagcacccctcccactggggctgtcaccccctctggccccctcattacctgctgaggtgggttgggaaggagcataggccgagagtgaggcagctccacccagaggcctcaggcaaagggctgggcctccttgggcctcagtttacccgtgtgcaaaatgaaggtgttgaaggaatcaggggtttcccaccctggcttccttggggaacatgtggaggaggcagggtcccaccccactccccgggtctcaggatcgggggcaggcctggaggtccacgctgcccgccaacgccgagggagcaccccgcaggagccccctgctggcactgcggcccttcagctctggctctccactcttccggcactgtggcttccccaccgctgtggttaattgtgcccttccagggctggtgggacggtgaggggttccgtggggctcctgctggcaccaggggtgggctccatggggtgtccgaggtgtgccttccacccggagatggtctgctgccctcgcgtcactgggccgcttcttccctctgactagaggccaagtgtggctgagctgctgttacctggagcaggaggcacagaggggccgggtgggcagcctgggctgtgccccactcaccttctccacctaccccaggtacctggacaacatccacctgcaccccgaggaggagaagtaccggaagatcaagctgcagaacaaggtgtttcaggagcgcattaactgcctggaagggacccacgagttttttgaggccattgggttccagaaggtgttgcttcccgcccaggatcaggaggaccccgaggagttctacgtgctgagcgagaccaccttggcccagccccagagcctggagaggcacaaggaacagctgctggctgcggagcccgtgcgcgccaagctggacaggcagcgccgcgtcttccagccctcgcccctggcctcgcagttcgaactgcctggggacttcttcaacctcacagcagaggagatcaagcgggagcagaggctcaggtccgaggcggtggagcggctgagcgtgctgcggaccaaggccatgcgggagaaggaggagcagcgggggctgcgcaagtacaactacacgctgctgcgcgtgcgcctccccgatggctgcctcctgcagggcactttctacgctcgggagcggctgggggcggtgtacgggttcgtccgggaggccctgcagagcgactggctgccttttgagctgctggcctcgggagggcagaagctgtccgaggacgagaacctggccttgaacgagtgcgggctggtgccctctgccctcctgaccttctcgtgggacatggctgtgctggaggacatcaaggccgcgggggccgagccggactccatcctgaaacccgagctcctgtcagccatcgagaagctcttgtgaaataaaagcagggttggcctcagccctgtgggtctgtctcatgctctccctgttcctctccccgccaccccagggcctccaagccacctctggaaatacttggctctgccccatgggcacgggaggggcgccagccgtggagctgtggaattgggccccgtggcagagcccccatcccttgggggctgtggggatgcgcccaagcccccgagggagaggcctggggacaccaacaaatctaagccctccctagctgcttggtaactgtgtcatgaagctgccggacagacacacgtggcatctccctgggcaggagagcaggcctgcagcatgggtcctgttcccgtgtgccgtgggtggcagtggctgcacctggcactagggctgctctgtggatgtgggtgacaacggcaggaggggatgctggccttcctgcacatagacctgcagttagtaaatcataagcccaaataaacaggttgtttgaatata

SEQ ID NO: 71832 - DNA, 1572 bp, Homo sapiens
ttttttcttccggtggctggtctccggcggccccgtccccgactgggccccgtgcccccccgcccccgcggccccccgccgccgggccagccgccaccatgaagaaattctttcaggagttcaaggccgacatcaagttcaagagcgcgggacccggtcagaagctcaaagagtccgtgggggaaaaggcccacaaagagaagcccaaccagccagcccccaggccgccccgccagggacccaccaatgaggcacagatggcagccgctgctgccctagcccggctggagcagaagcagtcccgggcctggggccccacatcgcaggacaccatccgaaaccaggtggccgcctccatcatgaagatctacacgttcaacaaagaccaggaccgggtgaagctgggtgtggacaccattgccaagtacctggacaacatccacctgcaccccgaggaggagaagtaccggaagatcaagctgcagaacaaggtgtttcaggagcgcattaactgcctggaagggacccacgagttttttgaggccattgggttccagaaggtgttgcttcccgcccaggatcaggaggaccccgaggagttctacgtgctgagcgagaccaccttggcccagccccagagcctggagaggcacaaggaacagctgctggctgcggagcccgtgcgcgccaagctggacaggcagcgccgcgtcttccagccctcgcccctggcctcgcagttcgaactgcctggggacttcttcaacctcacagcagaggagatcaagcgggagcagaggctcaggcactttctacgctcgggagcggctgggggcggtgtacgggttcgtccgggaggccctgcagagcgactggctgccttttgagctgctggcctcgggagggcagaagctgtccgaggacgagaacctggccttgaacgagtgcgggctggtgccctctgccctcctgaccttctcgtgggacatggctgtgctggaggacatcaaggccgcgggggccgagccggactccatcctgaaacccgagctcctgtcagccatcgagaagctcttgtgaaataaaagcagggttggcctcagccctgtgggtctgtctcatgctctccctgttcctctccccgccaccccagggcctccaagccacctctggaaatacttggctctgccccatgggcacgggaggggcgccagccgtggagctgtggaattgggccccgtggcagagcccccatcccttgggggctgtggggatgcgcccaagcccccgagggagaggcctggggacaccaacaaatctaagccctccctagctgcttggtaactgtgtcatgaagctgccggacagacacacgtggcatctccctgggcaggagagcaggcctgcagcatgggtcctgttcccgtgtgccgtgggtggcagtggctgcacctggcactagggctgctctgtggatgtgggtgacaacggcaggaggggatgctggccttcctgcacatagacctgcagttagtaaatcataagcccaaataaacaggttgtttgaatata

SEQ ID NO: 71833 - DNA, 795 bp, Homo sapiens
attcgagctcggtaccccattggataaggcactttctacgctcgggagcggctgggggcggtgtacgggttcgtccgggaggccctgcagagcgactggctgccttttgagctgctggcctcgggagggcagaagctgtccgaggacgagaacctggccttgaacgagtgcgggctggtgccctctgccctcctgaccttctcgtgggacatggctgtgctggaggacatcaaggccgcgggggccgagccggactccatcctgaaacccgagctcctgtcagccatcgagaagctcttgtgaaataaaagcagggttggcctcagccctgtgggtctgtctcatgctctccctgttcctctccccgccaccccagggcctccaagccacctctggaaatacttggctctgccccatgggcacgggaggggcgccagccgtggagctgtggaattgggccccgtggcagagcccccatcccttgggggctgtggggatgcgcccaagcccccgagggagaggcctggggacaccaacaaatctaagccctccctagctgcttggtaactgtgtcatgaagctgccggacagacacacgtggcatctccctgggcaggagagcaggcctgcagcatgggtcctgttcccgtgtgccgtgggtggcagtggctgcacctggcactagggctgctctgtggatgtgggtgacaacggcaggaggggatgctggccttcctgcacatagacctgcagttagtaaatcataagcccaaataaacaggttgtttgaatata

SEQ ID NO: 71834 - DNA, 1225 bp, Homo sapiens
ttttttcttccggtggctggtctccggcggccccgtccccgactgggccccgtgcccccccgcccccgcggccccccgccgccgggccagccgccaccatgaagaaattctttcaggagttcaaggccgacatcaagttcaagagcgcgggacccggtcagaagctcaaagagtccgtgggggaaaaggcccacaaagagaagcccaaccagccagcccccaggccgccccgccagggacccaccaatgaggcacagatggcagccgctgctgccctagcccggctggagcagaagcagtcccgggcctggggccccacatcgcaggacaccatccgaaaccaggtgagaaaggaacttcaagccgaagccaccgtcagcgggagccccgaggccccagggaccaacgtggtatctgagcccagagaggaaggctctgcccacctggctgtgcctggcgtgtacttcacctgtccgctcactggggccaccctgaggaaggaccagcgggacgcctgcatcaaggaggccattctcttgcacttctccaccgacccagtggccgcctccatcatgaagatctacacgttcaacaaagaccaggaccgggtgaagctgggtgtggacaccattgccaagtacctggacaacatccacctgcaccccgaggaggagaagtaccggaagatcaagctgcagaacaaggtgtttcaggagcgcattaactgcctggaagggacccacgagttttttgaggccattgggttccagaaggtgttgcttcccgcccaggatcaggaggaccccgaggagttctacgtgctgagcgagaccaccttggcccagccccagagcctggagaggcacaaggaacagctgctggctgcggagcccgtgcgcgccaagctggacaggcagcgccgcgtcttccagccctcgcccctggcctcgcagttcgaactgcctggggacttcttcaacctcacagcagaggagatcaagcgggagcagaggctcaggtccgaggcggtggagcggctgagcgtgctgcggaccaaggccatgcgggagaaggaggagcagcgggggctgcgcaagtacaactacacgctgctgcgcgtgcgcctccccgatggctgcctcctgcagggtgggcaccaacgatgcccgtggagggcggctcgggttggtagggggccctgggccccacccgctctgactccccc

SEQ ID NO: 71835 - DNA, 679 bp, Homo sapiens
ttttttcttccggtggctggtctccggcggccccgtccccgactgggccccgtgcccccccgcccccgcggccccccgccgccgggccagccgccaccatgaagaaattctttcaggagttcaaggccgacatcaagttcaagagcgcgggacccggtcagaagctcaaagagtccgtgggggaaaaggcccacaaagagaagcccaaccagccagcccccaggccgccccgccagggacccaccaatgaggcacagatggcagccgctgctgccctagcccggctggagcagaagcagtcccgggcctggggccccacatcgcaggacaccatccgaaaccaggtgagaaaggaacttcaagccgaagccaccgtcagcgggagccccgaggccccagggaccaacgtggtatctgagcccagagaggaaggctctgcccacctggctgtgcctggcgtgtacttcacctgtccgctcactggggccaccctgaggaaggaccagcgggacgcctgcatcaaggaggccattctcttgcacttctccaccgacccagtggccgcctccatcatgaagatctacacgttcaacaaagaccaggtacttggcaatggtgtccacacccagcttcacccgtcctgtctttgtgaacgtggggacctctagacaccacacaa

SEQ ID NO: 71836 - DNA, 756 bp, Homo sapiens
cccaatacacacgcacgtcgccaactagcgtaggtagagccctgggtgtgtatcaggcagaggcctgccccgcggccccccgccgccgggccagccgccaccatgaagaaattctttcaggagttcaaggccgacatcaagttcaagagcgcgggacccggtcagaagctcaaagagtccgtgggggaaaaggcccacaaagagaagcccaaccagccagcccccaggccgccccgccagggacccaccaatgaggcacagatggcagccgctgctgccctagcccggctggagcagaagcagtcccgggcctggggccccacatcgcaggacaccatccgaaaccaggtgagaaaggaacttcaagccgaagccaccgtcagcgggagccccgaggccccagggaccaacgtggtatctgagcccagagaggaaggctctgcccacctggctgtgcctggcgtgtacttcacctgtccgctcactggggccaccctgaggaaggaccagcgggacgcctgcatcaaggaggccattctcttgcacttctccaccgacccagtggccgcctccatcatgaagatctacacgttcaacaaagaccaggaccgggtgaagctgggtgtggacaccattgccaagtacctggacaacatccacctgcaccccgaggaggagaagtaccggaagatcaagctgcacatagacctgcagttagtaaatcataagcccaaataaacaggttgtttgaatata

SEQ ID NO: 71837 - DNA, 463 bp, Homo sapiens
gggcaggacttgcccgatggtgcagagctgagtggaaccagcatctccttcctccaggggctcttccgcctgcagtagaaccatctggtggctgcaggtggcccctgggaaccaggtgtcctggcccacataggcagggacacgtctggctgatggtgctggggaggggcagaagctcctctgtgtgactgcacgtcagctttgccggccacctcgggaggatacactcactctccctcggtctgttcccagggaaaaggcccacaaagagaagcccaaccagccagcccccaggccgccccgccagggacccaccaatgaggcacagatggcatggctgcacctggcactagggctgctctgtggatgtgggtgacaacggcaggaggggatgctggccttcctgcacatagacctgcagttagtaaatcataagcccaaataaacaggttgtttgaatata

SEQ ID NO: 71838 - DNA, 1813 bp, Homo sapiens
ggagtatagggcttgaactgagagcctggcctcccagaaggttttaatagacctacggcacagaaattgacacagcccggaaaaggcccacaaagagaagcccaaccagccagcccccaggccgccccgccagggacccaccaatgaggcacagatggcagccgctgctgccctagcccggctggagcagaagcagtcccgggcctggggccccacatcgcaggacaccatccgaaaccaggtgagaaaggaacttcaagccgaagccaccgtcagcgggagccccgaggccccagggaccaacgtggtatctgagcccagagaggaaggctctgcccacctggctgtgcctggcgtgtacttcacctgtccgctcactggggccaccctgaggaaggaccagcgggacgcctgcatcaaggaggccattctcttgcacttctccaccgacccagtggccgcctccatcatgaagatctacacgttcaacaaagaccaggaccgggtgaagctgggtgtggacaccattgccaagtacctggacaacatccacctgcaccccgaggaggagaagtaccggaagatcaagctgcagaacaaggtgtttcaggagcgcattaactgcctggaagggacccacgagttttttgaggccattgggttccagaaggtgttgcttcccgcccaggatcaggaggaccccgaggagttctacgtgctgagcgagaccaccttggcccagccccagagcctggagaggcacaaggaacagctgctggctgcggagcccgtgcgcgccaagctggacaggcagcgccgcgtcttccagccctcgcccctggcctcgcagttcgaactgcctggggacttcttcaacctcacagcagaggagatcaagcgggagcagaggctcaggtccgaggcggtggagcggctgagcgtgctgcggaccaaggccatgcgggagaaggaggagcagcgggggctgcgcaagtacaactacacgctgctgcgcgtgcgcctccccgatggctgcctcctgcagggcactttctacgctcgggagcggctgggggcggtgtacgggttcgtccgggaggccctgcagagcgactggctgccttttgagctgctggcctcgggagggcagaagctgtccgaggacgagaacctggccttgaacgagtgcgggctggtgccctctgccctcctgaccttctcgtgggacatggctgtgctggaggacatcaaggccgcgggggccgagccggactccatcctgaaacccgagctcctgtcagccatcgagaagctcttgtgaaataaaagcagggttggcctcagccctgtgggtctgtctcatgctctccctgttcctctccccgccaccccagggcctccaagccacctctggaaatacttggctctgccccatgggcacgggaggggcgccagccgtggagctgtggaattgggccccgtggcagagcccccatcccttgggggctgtggggatgcgcccaagcccccgagggagaggcctggggacaccaacaaatctaagccctccctagctgcttggtaactgtgtcatgaagctgccggacagacacacgtggcatctccctgggcaggagagcaggcctgcagcatgggtcctgttcccgtgtgccgtgggtggcagtggctgcacctggcactagggctgctctgtggatgtgggtgacaacggcaggaggggatgctggccttcctgcacatagacctgcagttagtaaatcataagcccaaataaacaggttgtttgaatata

SEQ ID NO: 71839 - DNA, 1340 bp, Homo sapiens
  misc_feature (1057)..(1057): n is a, c, g, or t
cacccgccctcatctgggcagcccagggaggtgcgggtggcagccctgcttcccaggccatgggtggctctctgggtgtggccgtgtgtgatggctgtgccgagcgtggatttgtgccccaatcttttccaggtcttagggtacgtactgttctcagcctctccatgctgggacgctgttcgcagtcagcagggctggttctgggaaacccccagagttccagctatgacttctcccctcccccggtaacataggtggataggtgggacctcggggaggggcaggggctgggggtatccgtcttccagctattgagtttcagacattgagggttgcagactcatttgtgtcctctctgccacctgccatccctgtgaccctggacgatgggcctctcggtctctttgtaaacatgaggcccgggagtggttccagaacgtccatcatggggctgcgagagcaggagggatggggcgtccatggtggcgggaggttctgtaagtggcggtggccttgatggatctcagcactgaggtcgagttctaaagccagagtgtgaggcacagttctgtcgcgtcacactggcttccaagtcccatggatctagccttgagaaggcggaaggggagacttgagttctgctgggtcttggctgcgtcgcctctgccctggggcgtgggcagggctgcggtcttggagggtctctcttttcctttctgtgatgagcgcacagctggggccgctccaagccgctgttctgccttccttttcctgcccctgttacctgggcagcggagggccgtgcggcccgggctctcagtgagtggctttccctgcttccctcctcccagcacttctccaccgacccagtggccgcctccatcatgaagatctacacgttcaacaaagaccaggaccgggtgaagctgggtgtggacaccattgccaagtacctggacaacatccacctgcaccccgaggaggagaagtaccggaagatcaagctgcagaacaaggtgtttcaggagcgcataacgtgctggaaggaccacgagtntttgggggcatgggtccagaagggtgcttccgccagatcaggagacccggagaagtctacgtgccgagtagaacaccttggccagcagaggctggagaggccagacacgtgggtgcggaccggggccaaggagggaggccggttcaacccgcctggccggggagcggggattcaccagagagaaaggcgcaagccgccccgggggggcccggacacacgaaagagggggcaccaccgggcccgccgagaacgggggggggcgcccccccgcgggcggggacgg

SEQ ID NO: 71840 - DNA, 1207 bp, Homo sapiens
taccgttaaacgctgaactatgtgtgggacccacgagttttttgaggccattgggttccagaaggtgttgcttcccgcccaggatcaggaggaccccgaggagttctacgtgctgagcgagaccaccttggcccagccccagagcctggagaggcacaaggaacagctgctggctgcggagcccgtgcgcgccaagctggacaggcagcgccgcgtcttccagccctcgcccctggcctcgcagttcgaactgcctggggacttcttcaacctcacagcagaggagatcaagcgggagcagaggctcaggtccgaggcggtggagcggctgagcgtgctgcggaccaaggccatgcgggagaaggaggagcagcgggggctgcgcaagtacaactacacgctgctgcgcgtgcgcctccccgatggctgcctcctgcagggcactttctacgctcgggagcggctgggggcggtgtacgggttcgtccgggaggccctgcagagcgactggctgccttttgagctgctggcctcgggagggcagaagctgtccgaggacgagaacctggccttgaacgagtgcgggctggtgccctctgccctcctgaccttctcgtgggacatggctgtgctggaggacatcaaggccgcgggggccgagccggactccatcctgaaacccgagctcctgtcagccatcgagaagctcttgtgaaataaaagcagggttggcctcagccctgtgggtctgtctcatgctctccctgttcctctccccgccaccccagggcctccaagccacctctggaaatacttggctctgccccatgggcacgggaggggcgccagccgtggagctgtggaattgggccccgtggcagagcccccatcccttgggggctgtggggatgcgcccaagcccccgagggagaggcctggggacaccaacaaatctaagccctccctagctgcttggtaactgtgtcatgaagctgccggacagacacacgtggcatctccctgggcaggagagcaggcctgcagcatgggtcctgttcccgtgtgccgtgggtggcagtggctgcacctggcactagggctgctctgtggatgtgggtgacaacggcaggaggggatgctggccttcctgcacatagacctgcagttagtaaatcataagcccaaataaacaggttgtttgaatata

SEQ ID NO: 71841 - DNA, 796 bp, Homo sapiens
cggacgcggtgggtcgacccacgcgtcgcgcactttctacgctcgggagcggctgggggcggtgtacgggttcgtccgggaggccctgcagagcgactggctgccttttgagctgctggcctcgggagggcagaagctgtccgaggacgagaacctggccttgaacgagtgcgggctggtgccctctgccctcctgaccttctcgtgggacatggctgtgctggaggacatcaaggccgcgggggccgagccggactccatcctgaaacccgagctcctgtcagccatcgagaagctcttgtgaaataaaagcagggttggcctcagccctgtgggtctgtctcatgctctccctgttcctctccccgccaccccagggcctccaagccacctctggaaatacttggctctgccccatgggcacgggaggggcgccagccgtggagctgtggaattgggccccgtggcagagcccccatcccttgggggctgtggggatgcgcccaagcccccgagggagaggcctggggacaccaacaaatctaagccctccctagctgcttggtaactgtgtcatgaagctgccggacagacacacgtggcatctccctgggcaggagagcaggcctgcagcatgggtcctgttcccgtgtgccgtgggtggcagtggctgcacctggcactagggctgctctgtggatgtgggtgacaacggcaggaggggatgctggccttcctgcacatagacctgcagttagtaaatcataagcccaaataaacaggttgtttgaatata

SEQ ID NO: 71842 - DNA, 752 bp, Homo sapiens
ttttttcttccggtggctggtctccggcggccccgtccccgactgggccccgtgcccccccgcccccgcggccccccgccgccgggccagccgccaccatgaagaaattctttcaggagttcaaggccgacatcaagttcaagagcgcgggacccggtcagaagctcaaagagtccgtgggggaaaaggcccacaaagagaagcccaaccagccagcccccaggccgccccgccagggacccaccaatgaggcacagatggcagccgctgctgccctagcccggctggagcagaagcagtcccgggcctggggccccacatcgcaggacaccatccgaaaccaggtgagaaaggaacttcaagccgaagccaccgtcagcgggagccccgaggccccagggaccaacgtggtatctgagcccagagaggaaggctctgcccacctggctgtgcctggcgtgtacttcacctgtccgctcactggggccaccctgaggaaggaccagcgggacgcctgcatcaaggaggccattctcttgcacttctccaccgacccagtggccgcctccatcatgaagatctacacgttcaacaaagaccaggaccgggtgaagctgggtgtggacaccattgccaagtacctggacaacatccacctgcaccccgaggaggagaagtaccggaagatcaagctgcacatagacctgcagttagtaaatcataagcccaaataaacaggttgtttgaatata

SEQ ID NO: 71843 - DNA, 676 bp, Homo sapiens
ttttttcttccggtggctggtctccggcggccccgtccccgactgggccccgtgcccccccgcccccgcggccccccgccgccgggccagccgccaccatgaagaaattctttcaggagttcaaggccgacatcaagttcaagagcgcgggacccggtcagaagctcaaagagtccgtgggggaaaaggcccacaaagagaagcccaaccagccagcccccaggccgccccgccagggacccaccaatgaggcacagatggcagccgctgctgccctagcccggctggagcagaagcagtcccgggcctggggccccacatcgcaggacaccatccgaaaccaggtgagaaaggaacttcaagccgaagccaccgtcagcgggagccccgaggccccagggaccaacgtgacaccaacaaatctaagccctccctagctgcttggtaactgtgtcatgaagctgccggacagacacacgtggcatctccctgggcaggagagcaggcctgcagcatgggtcctgttcccgtgtgccgtgggtggcagtggctgcacctggcactagggctgctctgtggatgtgggtgacaacggcaggaggggatgctggccttcctgcacatagacctgcagttagtaaatcataagcccaaataaacaggttgtttgaatata

SEQ ID NO: 71844 - DNA, 335 bp, Homo sapiens
caggttgcccgctgagttccctgccgcggcaagggccgactctcggtctcagagtgacggcctacccctaccgcaggtgccctctgccctcctgaccttctcgtgggacatggctgtgctggaggacatcaaggccgcgggggccgagccggactccatcctgaaacccgagctcctgtcagccatcgagaagctcttgtgaaataaaagcagggttggcctcagccctgtgggtctgtctcatgctctccctgttcctctccccgccaccccagggcctccaagccacctctggaaatacttggctctgccccatgggcacgggaggggcgcca

SEQ ID NO: 71845 - DNA, 574 bp, Homo sapiens
aacagaagaagccatttagattttacagaaatgtagctcctcatacattatattgttcctatgaagaattagattgaataaagctgctttgaataaagctcgtattaccagctaccacatgtgatggaaagaatccaagttaaacactctcaccagagcatgctccaagacagatgactgagccccaggcttggccaatacaatgcacttctattctctatttatttttgtagttcaaagacctggcagtaacccacttgatgcctgccataaggaccagtacactcctgattactgcccagcgattttatatctgtatgccagctactcagaccacgtataaagactagggggattttttgaaaggaaaagaaaccccggcttccacttatactttgaaatttcagatgatgtactgccaacttacagaccttgctttaatcagcagccacatgaaaaggctgtttctatttactctaggtcatttaggaaacaagcaataagtaggccttgcaaaatttcagcttctcttaaagttggcatgttttcctcaaatagagagttgaatcttgat

SEQ ID NO: 71846 - DNA, 2879 bp, Homo sapiens
tttccgtgttcggggttgtatccgtgttcggggttcccaacaacaatggcaacctccagagctcgcccgacaggcacagccagcaccgcttccaaagagccgctgaccacgagcctggcgccaacactcacgagcgagctgtccacctctcaggccgagaccagcacgcccaggacagagacgacaatgagccccttgactaacaccaccaccagccagggcacgacccgctgtcaaccgaagtgtgagtggacagagtggtttgacgtggacttcccaacctcagggttgcaggcggggacatggaaacttttgaaaacatcagggctgctgggggcaagatgtgctgggcaccaaagagcatagagtgccgggcggagaactaccccgaggtaagcatcgaccaggtcgggcaggtgctgacctgcagcctggagacggggctgacctgcaagaacgaagaccagacaggcaggttcaacatgtgcttcaactacaacgtgcgtgtgctttgctgtgacgactacagccactgccccagtaccccagccaccagctccacggccacgccctcctcaactccggggacgacctggatcctcacaaagccgaccacaacagccactacgactgcgtccactggatccacggccaccccgacctccaccctgagaacagctccccctcccaaagtgctgaccaccacggccaccacacccacagtcaccagctccaaagccactccctcctccagtccagggactgcaaccgcccttccagcactgagaagcacagccaccacacccacagctaccagcgttacacccatcccctcttcctccctgggcaccacctggacccgcctatcacagaccaccacacccacggccaccatgtccacagccacaccctcctccactccagagactgcccacacctccacagtgcttaccaccacggccaccacaactggggccaccggctctgtggccaccccctcctccaccccaggaacagctcacactaccaaagtgccaactaccacaaccacgggcttcacagccaccccctcctccagcccagggacggcactcacgcctccagtgtggatcagcacaaccaccacacccacaaccagaggctccacggtgaccccctcctccatcccggggaccacccacaccgccacagtgctgaccaccaccaccacaactgtggccactggttctatggcaacaccctcctctagcacacagaccagtggtactcccccatcactgaccaccacggccactacgatcacggccaccggctccaccaccaacccctcctcaactcctgggacaactcccatccccccagtgctgaccaccaccgccaccacacctgcagccaccagcaacacagtgactccctcctctgccctagggaccacccacacacccccagtgccgaacaccacggccaccacacacgggcgatccctgccccccagcagtccccacacggtgcgcacagcctggacttcggccacctcgggcatcttgggcaccacccacatcacagagccttccacggtgacttcccacaccctagcagcaaccaccggtaccacccagcactcgactccagccctttccagccctcaccctagcagcagaaccaccgagtcacccccttctccagggacgaccaccccgggccacaccacggccacctccaggaccacagccacggccacacccagcaagacccgcacctcgaccctgctgcccagcagccccacatcggcccccataaccacggtggtgaccatgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccatgccctcctccactccggggacgacctggatcctcacagagctgaccacaacagccactacgactgagtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccaccacggccaccacaaccggggccaccggctctgtggccaccccctcctccaccccaggaacagctcacactaccaaagtgctgactaccacaaccacgggcttcacagccaccccctcctccagcccagggacggcacgcacgcttccagtgtggatcagcacaaccaccacacccacaaccagaggttccacggtgacccccacagtgctgggactacgggcatgagccaccacacccatcataaattaaaac

SEQ ID NO: 71847 - DNA, 2658 bp, Homo sapiens
cgaggtcgctctgaggatcccctggacgtggacagagtggtttgacgtggacttcccaacctcagggttgcaggcggggacatggaaacttttgaaaacatcagggctgctgggggcaagatgtgctgggcaccaaagagcatagagtgccgggcggagaactaccccgaggtaagcatcgaccaggtcgggcaggtgctgacctgcagcctggagacggggctgacctgcaagaacgaagaccagacaggcaggttcaacatgtgcttcaactacaacgtgcgtgtgctttgctgtgacgactacagccactgccccagtaccccagccaccagctccacggccacgccctcctcaactccggggacgacctggatcctcacaaagccgaccacaacagccactacgactgcgtccactggatccacggccaccccgacctccaccctgagaacagctccccctcccaaagtgctgaccaccacggccaccacacccacagtcaccagctccaaagccactccctcctccagtccagggactgcaaccgcccttccagcactgagaagcacagccaccacacccacagctaccagcgttacacccatcccctcttcctccctgggcaccacctggacccgcctatcacagaccaccacacccacggccaccatgtccacagccacaccctcctccactccagagactgcccacacctccacagtgcttaccaccacggccaccacaactggggccaccggctctgtggccaccccctcctccaccccaggaacagctcacactaccaaagtgccaactaccacaaccacgggcttcacagccaccccctcctccagcccagggacggcactcacgcctccagtgtggatcagcacaaccaccacacccacaaccagaggctccacggtgaccccctcctccatcccggggaccacccacaccgccacagtgctgaccaccaccaccacaactgtggccactggttctatggcaacaccctcctctagcacacagaccagtggtactcccccatcactgaccaccacggccactacgatcacggccaccggctccaccaccaacccctcctcaactcctgggacaactcccatccccccagtgctgaccaccaccgccaccacacctgcagccaccagcaacacagtgactccctcctctgccctagggaccacccacacacccccagtgccgaacaccacggccaccacacacgggcgatccctgccccccagcagtccccacacggtgcgcacagcctggacttcggccacctcgggcatcttgggcaccacccacatcacagagccttccacggtgacttcccacaccctagcagcaaccaccggtaccacccagcactcgactccagccctttccagccctcaccctagcagcagaaccaccgagtcacccccttctccagggacgaccaccccgggccacaccacggccacctccaggaccacagccacggccacacccagcaagacccgcacctcgaccctgctgcccagcagccccacatcggcccccataaccacggtggtgaccatgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccatgccctcctccactccggggacgacctggatcctcacagagctgaccacaacagccactacgactgagtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccaccacggccaccacaaccggggccaccggctctgtggccaccccctcctccaccccaggaacagctcacactaccaaagtgctgactaccacaaccacgggcttcacagccaccccctcctccagcccagggacggcacgcacgcttccagtgtggatcagcacaaccaccacacccacaaccagaggttccacggtgacccccacagtgctgggactacgggcatgagccaccacacccatcataaattaaaac

SEQ ID NO: 71848 - DNA, 2220 bp, Homo sapiens
gcggcgactctaaggatcccgatcacgtgcattgtgctgaccaccacggccaccacacccacagtcaccagctccaaagccactccctcctccagtccagggactgcaaccgcccttccagcactgagaagcacagccaccacacccacagctaccagcgttacacccatcccctcttcctccctgggcaccacctggacccgcctatcacagaccaccacacccacggccaccatgtccacagccacaccctcctccactccagagactgcccacacctccacagtgcttaccaccacggccaccacaactggggccaccggctctgtggccaccccctcctccaccccaggaacagctcacactaccaaagtgccaactaccacaaccacgggcttcacagccaccccctcctccagcccagggacggcactcacgcctccagtgtggatcagcacaaccaccacacccacaaccagaggctccacggtgaccccctcctccatcccggggaccacccacaccgccacagtgctgaccaccaccaccacaactgtggccactggttctatggcaacaccctcctctagcacacagaccagtggtactcccccatcactgaccaccacggccactacgatcacggccaccggctccaccaccaacccctcctcaactcctgggacaactcccatccccccagtgctgaccaccaccgccaccacacctgcagccaccagcaacacagtgactccctcctctgccctagggaccacccacacacccccagtgccgaacaccacggccaccacacacgggcgatccctgccccccagcagtccccacacggtgcgcacagcctggacttcggccacctcgggcatcttgggcaccacccacatcacagagccttccacggtgacttcccacaccctagcagcaaccaccggtaccacccagcactcgactccagccctttccagccctcaccctagcagcagaaccaccgagtcacccccttctccagggacgaccaccccgggccacaccacggccacctccaggaccacagccacggccacacccagcaagacccgcacctcgaccctgctgcccagcagccccacatcggcccccataaccacggtggtgaccatgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccatgccctcctccactccggggacgacctggatcctcacagagctgaccacaacagccactacgactgagtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccaccacggccaccacaaccggggccaccggctctgtggccaccccctcctccaccccaggaacagctcacactaccaaagtgctgactaccacaaccacgggcttcacagccaccccctcctccagcccagggacggcacgcacgcttccagtgtggatcagcacaaccaccacacccacaaccagaggttccacggtgacccccacagtgctgggactacgggcatgagccaccacacccatcataaattaaaac

SEQ ID NO: 71849 - DNA, 783 bp, Homo sapiens
acctggcgaccgttacacagagaaaacagctataactctgtcacgagaaaaaccggcaggcctttttcacacagaaaaacgacctggatcctcacagagctgaccacaacagccactacgactgagtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccaccacggccaccacaaccggggccaccggctctgtggccaccccctcctccaccccaggaacagctcacactaccaaagtgctgactaccacaaccacgggcttcacagccaccccctcctccagcccagggacggcacgcacgcttccagtgtggatcagcacaaccaccacacccacaaccagaggttccacggtgacccccacagtgctgggactacgggcatgagccaccacacccatcataaattaaaac

SEQ ID NO: 71850 - DNA, 2791 bp, Homo sapiens
tttccgtgttcggggttgtatccgtgttcggggttcccaacaacaatggcaacctccagagctcgcccgacaggcacagccagcaccgcttccaaagagccgctgaccacgagcctggcgccaacactcacgagcgagctgtccacctctcaggccgagaccagcacgcccaggacagagacgacaatgagccccttgactaacaccaccaccagccagggcacgacccgctgtcaaccgaagtgtgagtggacagagtggtttgacgtggacttcccaacctcagggttgcaggcggggacatggaaacttttgaaaacatcagggctgctgggggcaagatgtgctgggcaccaaagagcatagagtgccgggcggagaactaccccgaggtaagcatcgaccaggtcgggcaggtgctgacctgcagcctggagacggggctgacctgcaagaacgaagaccagacaggcaggttcaacatgtgcttcaactacaacgtgcgtgtgctttgctgtgacgactacagccactgccccagtaccccagccaccagctccacggccacgccctcctcaactccggggacgacctggatcctcacaaagccgaccacaacagccactacgactgcgtccactggatccacggccaccccgacctccaccctgagaacagctccccctcccaaagtgctgaccaccacggccaccacacccacagtcaccagctccaaagccactccctcctccagtccagggactgcaaccgcccttccagcactgagaagcacagccaccacacccacagctaccagcgttacacccatcccctcttcctccctgggcaccacctggacccgcctatcacagaccaccacacccacggccaccatgtccacagccacaccctcctccactccagagactgcccacacctccacagtgcttaccaccacggccaccacaactggggccaccggctctgtggccaccccctcctccaccccaggaacagctcacactaccaaagtgccaactaccacaaccacgggcttcacagccaccccctcctccagcccagggacggcactcacgcctccagtgtggatcagcacaaccaccacacccacaaccagaggctccacggtgaccccctcctccatcccggggaccacccacaccgccacagtgctgaccaccaccaccacaactgtggccactggttctatggcaacaccctcctctagcacacagaccagtggtactcccccatcactgaccaccacggccactacgatcacggccaccggctccaccaccaacccctcctcaactcctgggacaactcccatccccccagtgctgaccaccaccgccaccacacctgcagccaccagcaacacagtgactccctcctctgccctagggaccacccacacacccccagtgccgaacaccacggccaccacacacgggcgatccctgccccccagcagtccccacacggtgcgcacagcctggacttcggccacctcgggcatcttgggcaccacccacatcacagagccttccacggtgacttcccacaccctagcagcaaccaccggtaccacccagcactcgactccagccctttccagccctcaccctagcagcagaaccaccgagtcacccccttctccagggacgaccaccccgggccacaccacggccacctccaggaccacagccacggccacacccagcaagacccgcacctcgaccctgctgcccagcagccccacatcggcccccataaccacggtggtgaccatgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccatgccctcctccactccggggacgacctggatcctcacagagctgaccacaacagccactacgactgagtccactggatccacggccaccccgtcctccaccccagaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccaccacggccaccacaaccggggccaccggctctgtggccaccccctcctccaccccaggaacagctcacactaccaaagtgctgactaccacaaccacgggcttcacagccaccccctcctccagcccagggacggcacgcacgcttccagtgtggatcagcacaaccaccacacccacaaccagaggttccacggtgacccccacagtgctgggactacgggcatgagccaccacacccatcataaattaaaac

SEQ ID NO: 71851 - DNA, 996 bp, Homo sapiens
acagcgatatgacaccttacgtgaaaattcgttcgcgtattcacgccgacatgatagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccatgccctcctccactccggggacgacctggatcctcacagagctgaccacaacagccactacgactgagtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccaccacggccaccacaaccggggccaccggctctgtggccaccccctcctccaccccaggaacagctcacactaccaaagtgctgactaccacaaccacgggcttcacagccaccccctcctccagcccagggacggcacgcacgcttccagtgtggatcagcacaaccaccacacccacaaccagaggttccacggtgacccccacagtgctgggactacgggcatgagccaccacacccatcataaattaaaac

SEQ ID NO: 71852 - DNA, 1460 bp, Homo sapiens
  misc_feature (2)..(2): n is a, c, g, or t
  misc_feature (4)..(4): n is a, c, g, or t
gncnctatgctcccggggacattctaaccgccgccaggtcccgccgcctctcgccccgctattaataccggcggcccgggaggggggcgcagcacgcgccgcgcagccatggggaggctgctggccttagtggtcggcgcggcactggtgtcctcagcctgcgggggctgcgtggaggtggactcggagaccgaggccgtgtatgggatgaccttcaaaattctttgcatctcctgcaagcgccgcagcgagaccaacgctgagaccttcaccgagtggaccttccgccagaagggcactgaggagtttgtcaagatcctgcgctatgagaatgaggtgttgcagctggaggaggatgagcgcttcgagggccgcgtggtgtggaatggcagccggggcaccaaagacctgcaggatctgtctatcttcatcaccaatgtcacctacaaccactcgggcgactacgagtgccacgtctaccgcctgctcttcttcgaaaactacgagcacaacaccagcgtcgtcaagaagatccacattgaggtagtggacaaagccaacagagacatggcatccatcgtgtctgagatcatgatgtatgtgctcattgtggtgttgaccatatggctcgtggcagagatgatttactgctacaagaagatcgctgccgccacggagactgctgcacaggagaatgcctcggaatacctggccatcacctctgaaagcaaagagaactgcacgggcgtccaggtggccgaatagccctggccctgggccccgcctcaaggaagagccagccgtaatggggactctccaggcaccgcctgcccccagcgtgggggtggccactcctgggccccagaaagcctcagagtcctgccgacggagccactggggtgggagggggcagggggcttggctcgcacccccactttcgcctcctccagctcctgccccgccggccgcgcaccgccatgcatgatgggtaaagcaatactgccgctgcccccaccctgcttctgctgcctgtttggggaggggggcggtgaggtgggggcagcggccccgcacccctcctccttgctgatttgcacacattggccgcttcagacacgcacttctggggccagcccctccccgcctcctccctgcctggcggcaggggtcgcgatgatgggctggagcagtttggggcagggggttctgggacccactccgactccccctccccggcatcatttcccctcccgcttcctccggctggacctggggtcccccctccctgtaatgcactcctgccccggcccaacctcgccctctctcaccagccttgaactgtggccacctagaaaggggcccattcagcctcgtctctttacagaagtagttttgttcatgaaataaagactcttggacttgaaaaaagaaaaacatacccatttaaacacatgccttgg

SEQ ID NO: 71853 - DNA, 1394 bp, Homo sapiens
  misc_feature (2)..(2): n is a, c, g, or t
  misc_feature (4)..(4): n is a, c, g, or t
gncnctatgctcccggggacattctaaccgccgccaggtcccgccgcctctcgccccgctattaataccggcggcccgggaggggggcgcagcacgcgccgcgcagccatggggaggctgctggccttagtggtcggcgcggcactggtgtcctcagcctgcgggggctgcgtggaggtggactcggagaccgaggccgtgtatgggatgaccttcaaaattctttgcatctcctgcaagcgccgcagcgagaccaacgctgagaccttcaccgagtggaccttccgccagaagggcactgaggagtttgtcaagatcctgcgctatgagaatgaggtgttgcagctggaggaggatgagcgcttcgagggccgcgtggtgtggaatggcagccggggcaccaaagacctgcaggatctgtctatcttcatcaccaatgtcacctacaaccactcgggcgactacgagtgccacgtctaccgcctgctcttcttcgaaaactacgagcacaacaccagcgtcgtcaagaagatccacattgaggtagtggacaaagccaacagagacatggcatccatcgtgtctgagatcatgatgtatgtgctcattgtggtgttgaccatatggctcgtggcagagatgatttactgctacaagaagatcgctgccgccacggagactgctgcacaggagaatgcctcggaatacctggccatcacctctgaaagcaaagagaactgcacgggcgtccaggtggccgaatagccctggccctgggccccgcctcaaggaagagccagccgtaatggggactctccaggcaccgcctgcccccagcgtgggggtggccactcctgggccccagaaagcctcagagtcctgccgacggagccactggggtgggagggggcagggggcttggctcgcacccccactttcgcctcctccagctcctgccccgccggccgcgcaccgccatgcatgatgggtaaagcagcggccccgcacccctcctccttgctgatttgcacacattggccgcttcagacacgcacttctggggccagcccctccccgcctcctccctgcctggcggcaggggtcgcgatgatgggctggagcagtttggggcagggggttctgggacccactccgactccccctccccggcatcatttcccctcccgcttcctccggctggacctggggtcccccctccctgtaatgcactcctgccccggcccaacctcgccctctctcaccagccttgaactgtggccacctagaaaggggcccattcagcctcgtctctttacagaagtagttttgttcatgaaataaagactcttggacttgaaaaaagaaaaacatacccatttaaacacatgccttgg

SEQ ID NO: 71854 - DNA, 1360 bp, Homo sapiens
  misc_feature (2)..(2): n is a, c, g, or t
  misc_feature (4)..(4): n is a, c, g, or t
gncnctatgctcccggggacattctaaccgccgccaggtcccgccgcctctcgccccgctattaataccggcggcccgggaggggggcgcagcacgcgccgcgcagccatggggaggctgctggccttagtggtcggcgcggcactggtgtcctcagcctgcgggggctgcgtggaggtggactcggagaccgaggccgtgtatgggatgaccttcaaaattctttgcatctcctgcaagcgccgcagcgagaccaacgctgagaccttcaccgagtggaccttccgccagaagggcactgaggagtttgtcaagatcctgcgctatgagaatgaggtgttgcagctggaggaggatgagcgcttcgagggccgcgtggtgtggaatggcagccggggcaccaaagacctgcaggatctgtctatcttcatcaccaatgtcacctacaaccactcgggcgactacgagtgccacgtctaccgcctgctcttcttcgaaaactacgagcacaacaccagcgtcgtcaagaagatccacattgaggtagtggacaaagccaacagagacatggcatccatcgtgtctgagatcatgatgtatgtgctcattgtggtgttgaccatatggctcgtggcagagatgatttactgctacaagaagatcgctgccgccacggagactgctgcacaggagaatgcctcggaatacctggccatcacctctgaaagcaaagagaactgcacgggcgtccaggtggccgaatagccctggccctgggccccgcctcaaggaagagccagccgtaatggggactctccaggcaccgcctgcccccagcgtgggggtggccactcctgggccccagaaagcctcagagtcctgccgacggagccactggggtgggagggggcagggggcttggctcgcacccccactttcgcctcctccagctcctgccccgccggccgcgcaccgccatgcatgatgggtaaagcagcggccccgcacccctcctccttgctgatttgcacacattggccgcttcagacacgcacttctggggccagcccctccccgcctcctccctgcctggcggcaggggtcgcgatgatgggctggagcagtttggggcagggggttctgggacccactccgactccccctccccggcatcatttcccctccctgtaatgcactcctgccccggcccaacctcgccctctctcaccagccttgaactgtggccacctagaaaggggcccattcagcctcgtctctttacagaagtagttttgttcatgaaataaagactcttggacttgaaaaaagaaaaacatacccatttaaacacatgccttgg

SEQ ID NO: 71855 - DNA, 715 bp, Homo sapiens
gcatgtgtgtttgcagtttcctctactttatgggagatttcctcactttatcttgtcacatgtctgtagtgtttcatttcttctatcttgtgtatttataatgtctaaggttttgctgttattattctatgattttttagagtattcttgttccatgggtatactagcttctcttctgcctatgagtatattaacagcttttttttaattgagctgtatggcccagcatgtgatttatcttggtgaattctctccatatgcttgaaaaaaatacaacaatcttgcgcttgttggatcagtgttctagaaatgtcaataggtcaaattagttaatgctgttatttagttctatggctttactgattttttttccacttgttctatcaattactaagacagacggattaagtcttcaactatagtagatttttctgtttctccttgcagttctttcagttttcatgtattttgagggtctttttaaaaatgcatacacatttaagatttttatgccctctttatgaattaatcctttatcattattaaatatcccttattatccctggtaatattttttgtactgaagtctactttgtctgatagtaatataaccattctggctttcttataattagtgtttttatgacacatatttttatatgattttactttttatctatgcctttatgattaaagtgggtttcttgtatacagc

SEQ ID NO: 71856 - DNA, 416 bp, Homo sapiens
gctcaggaagaggccagcaagaaccctgaagccaagggtctgagcagagggagttggcaggcctagctcctgtgccccactccgaccctccctgctcatgcggcagtgggtgggtgaggtgggctggggccctggaggagtgcctttgaggaggtcagtcctggcaggtggacagaggacgcctggcatgggctgcttactgggaccccaggcggccctggccatggccacagtcttccttcttttggcgtgtgggctggtaccagatctggggattttctaaagggactggggggaggggagggcattgtcaatggtggtatctttagcctgagacagaagatttttaaaggcaaaattatatttctggtttgttgtttcagaagaccaataaagactgtattttcctatgtact

SEQ ID NO: 71857 - DNA, 351 bp, Homo sapiens
agaataacaacaggaccaacatgctggggtggctgtggggattaaatggcaagcctcagtttccccatatgtgcctaaagcaagagggccggacccctggtcagccctaaggtgggaataccttagtgtctgcaggctcagtttggccccagttcgaggcgcctcaaaaggtgccacagaggcccctcccaatcgcccatcctgcacctcaccctgtattttgctgcagccacaatcctggaattggccctttcctattttagcctatttttgagttcgtggcagggaacagaggagcagggtcacgccctgcaatttctctccctgagagcccttgaggacatcaggatt

SEQ ID NO: 71858 - DNA, 512 bp, Homo sapiens
ccatatcacccaactcccacttggagtagaacttcacaaaacgacagagggacagctgtttccatcaaacacttccacagcttcacctgagacgagggcatgactctgggaacatcaggaggctgatggactattaagccaaacaattcctacaaaaattccctgcaccttccactgcgtttcagtccttgacagacataagtaagggatcaagtgagaagaggaaggaaaatacaggatccaaggaatcaacaatgctagcactgaagagcaggattacggaggagctgtgctctgggagcatatatggtgatcaatcagatgcatgacttttttttcaaaattttaaatgtcttgagcatgctacttccaaccattctacccacaaataaactgcaataggacttggttagatttcaatgattatgaataaatgttcaccttcataccttctggttacaaagctaaactttaaaatgtccaaataaaatattcactaaaatttaaaattg

SEQ ID NO: 71859 - DNA, 384 bp, Homo sapiens
aacaaatgggagaactcagtaatgtagtctctggattatgtaatcctaatgcttgcaactattagtagaatccaagctaattcctcttgaaaaactaagttgtggccgggtgcagtggctcacgcctgtaatcccagcactttgggaggccaaggtgggcggatcacgaggtcaggagatcaagaacatcctggctaacacggtgaaaccccatctctactaaaaatacaaaaaattagccgggtgtggtggcaggcgcctgtagtcccagctactggggaggctgaggcaggagaatggcatgaacccgggaggcagagctggcagtgagccgagatcacgccactgcactccagcctgggcgacagagtgagactccgtctg

SEQ ID NO: 71860 - DNA, 746 bp, Homo sapiens
attaaatatgaaattacatctgtgtacttgagctgaatgacaggacactggtttataatgactaaagatgtatgattgcattttccacactcgtggcagagagatgagtattccattgtgtgtgacatttccagcaattcatattgaagatgtgttttaaaatcattaacttattactatctaaataaggaatataaattaatacttaccaagcaagtaaaaatagcaaatctttaagcaacttgaaattttgtacggtagcacaaaaactcacaagatattgatcctggctgtactaaagagtgactaggtgatatattaaagagtgcataataatgagtgattaagggtcatttaaattattttacatgcagataattatattgtgtttgaaatgtcaaagacaacttacctgatgtatgtgtatgtaggaaaaacaaaaagcaaaactgtggtattttgtgtatctgtgtctttttctgtctttttgcatctttgttttttttctctctctctctctctgattttctttaaaagaggtcattaattctcctgtgagagaaacttttctttaccagaggaaaactacgcaattgtaaaatatagtttgcaagatgaaagaaatgtttctccaaacacttcaccttctctaagagatttctttgcatcttacctggactgctgaagaagcattttcacagtatcctttgcccacttacgggtggtattatttgctgtattgtttg

SEQ ID NO: 71861 - DNA, 626 bp, Homo sapiens
tatgacatagttgttaaaattcttgtgttttcacgtggatttaagaactaagaactgagtgaattaattttaggagactgtcatgcctgtgtgtgtgtgagagagagagagaaggagggagggaaagagagcgaaagagggaagaaagaggcagggatggaggaaagtaagagagaaggaggaaaggaagaaagagagagcaaaggagggaaggaaggagagagagaagaagagagaaagagaaggagggagggagaagaaatgaaggatggaggaagagagagagagaacacaattggctgattaataaaggaagccattttaaaaggttctaacacttcagtgagagaggcaaaagtcaagcatgaatgattaatgtccctttctatcaatcctgcattgggtctgcaagtggcaggtgctactaaagactctaggaccaagaagctaaaagataactttctcagcatgatgagaatctgcaatctcgggactctgaggaggcaaggtccccacggagggccaacacccggggcgtgggattacagcgcagctcctgactgccgctctcaggaggccagtctcaaagtctaccttcctctccctccaaaaaaagacaagctttg

SEQ ID NO: 71862 - DNA, 270 bp, Homo sapiens
tgagtatctttattcctttattaacttagggcagatataaaataaaggataatatatgacaaattctcacttaccaagaatggttggttgctatttagggtaggctaacagctgtgacagtacactccaaaatgtataattacgtaaacacatattcaattcttgctaacatagcagtactttgctgtgagcaggtcagcaggaacccttttctgcagtcactcagggacccagacttacagagtgggtaggatgcatctgatccagagt

SEQ ID NO: 71863 - DNA, 1112 bp, Homo sapiens
aattcagtctgcagggaggaaagtcagaattagatattcaagatggccgcctctgatggagtccctggcactcactcaagcttgcatttggtagatggtgacacaagaatccatgctgaaggctgccttgcctctctttaccagattcatcatcagcaatggactgcggaccgagcacggggtgtttgagatcacactggagactgtggacagagccctgcctgtggtaaccaggaacaaggggttgagactggcccaaggggccgtgggcctgctttcccctgacctccttcagctgaccgaccctgatacacctgcggagaacctcaccttcctcttggttcagctcccccagcatggccagctctacctgtgggggacagggctacttcaacacaatttcacccagcaggatgtggacagcaagaatgtggcctatcggcactcaggaggggactcccagactgactgctttactttcatggccacagacgggacaaaccaaggctttattgtgaatgggagagtgtgggaagaacctgttttattcaccattcaggtagaccaattggacaaaacagctcctcgtatcacactcttgcattccccttctcaagtggggctcctgaaaaatggctgctacgggatttacatcacttcccgcgtgttgaaggcatcagaccctgacactgaggacgatcagatcatctttaaaattctacaaggcccaaaacatggacatctggagaacacaacaacaggtgaatttatccatgagaaatttagccaaaaggacttaaacagtaagactattctttacatcataaacccatctttggaagtaaattcagataccgtggaatttcaaatcatggaccccacagggaactcggccactcctcaaattttggaactgaagtggtctcatattgaatggtcacagaccgaatatgaagtctgtgcagaactgtcgcggtttgttgcccttggaaattatcagaaggggatattccatggactcggcctttgtgggtataaagttcctccaagtctcaactgtcacttgcgcaagattttcaccgtgagttccagctcaagcgctgatgtttgac

SEQ ID NO: 71864 - DNA, 1230 bp, Homo sapiens
aattcagtctgcagggaggaaagtcagaattagatattcaagatggccgcctctgatggagtccctggcactcactcaagcttgcatttggtagatggtgacacaagaatccatgctgaaggctgccttgcctctctttaccagattcatcatcagcaatggactgcggaccgagcacggggtgtttgagatcacactggagactgtggacagagccctgcctgtggtaaccaggaacaaggggttgagactggcccaaggggccgtgggcctgctttcccctgacctccttcagctgaccgaccctgatacacctgcggagaacctcaccttcctcttggttcagctcccccagcatggccagctctacctgtgggggacagggctacttcaacacaatttcacccagcaggatgtggacagcaagaatgtggcctatcggcactcaggaggggactcccagactgactgctttactttcatggccacagacgggacaaaccaaggctttattgtgaatgggagagtgtgggaagaacctgttttattcaccattcaggtagaccaattggacaaaacagctcctcgtatcacactcttgcattccccttctcaagtggggctcctgaaaaatggctgctacgggatttacatcacttcccgcgtgttgaaggcatcagaccctgacactgaggacgatcagatcatctttaaaattctacaaggcccaaaacatggacatctggagaacacaacaacaggtgaatttatccatgagaaatttagccaaaaggacttaaacagtaagactattctttacatcataaacccatctttggaagtaaattcagataccgtggaatttcaaatcatggaccccacagggaactcggccactcctcaaattttggaactgaagtggtctcatattgaatggtcacagaccgaatatgaagtctgtgcagaactgtcgcggtttgttgcccttggaaattatcagaaggggatattccatggactcggcctttgtgggtataaaggtcaaccaagtgtcagctgcagttggaaaagatttcaccgtgattccatctaaactgattcagtttgacccaggaatgtcaactaagatgtggaatatagcaattacctatgacggattagaggaagatgatgaggtctttgaagtaattctgaactcccctgtgaatgcagttcttggcacaaagacaa

SEQ ID NO: 71865 - DNA, 1006 bp, Homo sapiens
cacaagagcaaggtgactgtctccagtgacagattcagattcatcatcagcaatggactgcggaccgagcacggggtgtttgagatcacactggagactgtggacagagccctgcctgtggtaaccaggaacaaggggttgagactggcccaaggggccgtgggcctgctttcccctgacctccttcagctgaccgaccctgatacacctgcggagaacctcaccttcctcttggttcagctcccccagcatggccagctctacctgtgggggacagggctacttcaacacaatttcacccagcaggatgtggacagcaagaatgtggcctatcggcactcaggaggggactcccagactgactgctttactttcatggccacagacgggacaaaccaaggctttattgtgaatgggagagtgtgggaagaacctgttttattcaccattcaggtagaccaattggacaaaacagctcctcgtatcacactcttgcattccccttctcaagtggggctcctgaaaaatggctgctacgggatttacatcacttcccgcgtgttgaaggcatcagaccctgacactgaggacgatcagatcatctttaaaattctacaaggcccaaaacatggacatctggagaacacaacaacaggtgaatttatccatgagaaatttagccaaaaggacttaaacagtaagactattctttacatcataaacccatctttggaagtaaattcagataccgtggaatttcaaatcatggaccccacagggaactcggccactcctcaaattttggaactgaagtggtctcatattgaatggtcacagaccgaatatgaagtctgtgcagaactgtcgcggtttgttgcccttggaaattatcagaaggggatattccatggactcggcctttgtgggtataaagttcctccaagtctcaactgtcacttgcgcaagattttcaccgtgagttccagctcaagcgctgatgtttgac

SEQ ID NO: 71866 - DNA, 555 bp, Homo sapiens
ggaaaagatttcaccgtgattccatctaaactgattcagtttgacccaggtacattttgtgtctgcagtttgttttatgtgttttgttttttgtttttttttgtaggcatgtctggagattgtagagaagatagaatgttacacaactttagccaactagaaactcctcagggagccataccacctcactctaaaagagaggtgtttggatttgaggttttgcccttatttttttttagtaacaaatgaattttgatttcaaatgagaagaaagattataataaatatgagatatcaaagcaaacatccaagacaatccagaaaaaaatacagtcacttagaaattatttgaagttctaacacaaagctgttatagtttaattgcctcagatattttatgaaaattttcagaatgttatgtttatatggattcctaaagggcatttctaaatgatccctcatggaataggttgatattaggagattccaggggaaattattatttagttaagtagcacttactttgttttaaatttgtggaaaaattttgctagg

SEQ ID NO: 71867 - DNA, 881 bp, Homo sapiens
ccaagatttcatgatggttagctctctctgttcaaaacctcgttcagtagagataacttgagaatgtgtttttgcccaatgtctcttccctgtcttttttccacttcccatttgattcttcttttcctgtctcctatgttttctgtctcactggtggatctgagaattgagggaggaacaagggaagacgaggtgagaacggagtgaaggtgctatgttcacataccctggggtagaaatggaaaccatctcagtgtttaacttttgcttaaaaaaaaaatcaatcttatttttagaacagttttaggttcaaacaaaagtgagctgaggccatgtgcattggttcatgcctgtaatcccaacactttgagaggctgagttgggccgattgctcgagcccaggagttcaagaccagcctgggcaacatggtgaaaccctgtctctaccaaaaaaaaaaaaaagaaaaaaagaatttgctgggcatggtggtgcatgcctgtagttccagctgctcaggaggctgaggtaggaggattgcttgagcctggggggttggaggctgcagtgagctgtgatcaaccactgcactccaacctgggtgatggagtgagaccctgtctcaaaacaaaacaaaacaaaaagaacaaaatggaactttaagtgtggagagttcccatatacttcctggcccatatgtacacaacctcccccattgttgccatccctcaccacagtgacacatttattacaatcagtgaacccacactgacacatcattgtcactcaaaatttagaatttaccttagggttcactcttggtgttgtacagtctatgaattttgacaaatgtataaagatgtagtccatcattataacatca

SEQ ID NO: 71868 - DNA, 277 bp, Homo sapiens
tccatttgttgcaacctgtgttttaggtgttatatatcgaaacattgccagatccagtgtcatgaaactttttaattattttgccttaagcctttcttctatgagttgttataaatttggcccttacatttaggtttttgttcaattttgagttaatttttgtatgtggtgttaggtaagggaccaactttattcttttgcatgttgatgtccagatatcccaaaaccatttgttgaaaagattgtctgctctccattgtgtggacttggtaccttt

SEQ ID NO: 71869 - DNA, 915 bp, Homo sapiens
tcttgctatgtctgctaaagaacgagcatcagcctttcaagcttgacaggcagtgtgatgtgttctgaaagtgtccagggcaaagcgtagggagagggtggatttgtgcagggtgcagctctggagaagaagctggatcactcttggtcccattccctaggccctgagcaagtcaggctcctggctctgggtgtggctcccccaaacgaagtactgacttcagcctgtgaggggagggttgagggaggctctggaaagcccagccacacctgagtccctggcagtagccttggggcagagggcacccgcagagtcccagagatgatgtgggcagtgggcagagagagccttggcgcctctgtttgccaccacttccccaggaaggagggacagcatttctctggctggttccactaaatgtgccagcccaaatgcagggcatgggctctggttctgccaggagcctgtgacacccccaggaagggggtggaactgaggaagagcgaggatatgcaggcactcatgcttaccgggactggggcagctcactaggattctatcctttccaatcggcatcagccagctcttgtcccctgataagtgaggacagcctgaccctggcctcaaatgcagccatccctgagttcatgcgatgctgacgggaccccagcacacttccctgcctcctttgagatctgcgagcccttgctgcagttcagattcaacaaggccctctgcccaccctctcactaggcctcacccaacaccagtggaactggagcctctggctgggcacagtggctcactttgggaggctgaggcaggaaggctgctggaaactgagagttcaagaccagcctgggcaacatagtgagaccctgtctctacaaatacaaaataaaataattagctggg

SEQ ID NO: 71870 - DNA, 1055 bp, Homo sapiens
tcttgctatgtctgctaaagaacgagcatcagcctttcaagcttgacaggcagtgtgatgtgttctgaaagtgtccagggcaaagcgtagggagagggtggatttgtgcagggtgcagctctggagaagaagctggatcactcttggtcccattccctaggccctgagcaagtcaggctcctggctctgggtgtggctcccccaaacgaagtactgacttcagcctgtgaggggagggttgagggaggctctggaaagcccagccacacctgagtccctggcagtagccttggggcagagggcacccgcagagtcccagagatgatgtgggcagtgggcagagagagccttggcgcctctgtttgccaccacttccccaggaaggagggacagcatttctctggctggttccactaaatgtgccagcccaaatgcagggcatgggctctggttctgccaggagcctgtgacacccccaggaagggggtggaactgaggaagagcgaggatatgcaggcactcatgcttaccgggactggggcagctcactaggattctatcctttccaatcggcatcagccagctcttgtcccctgataagtgaggacagcctgaccctggcctcaaatgcagccatccctgagttcatgcgatgctgacgggaccccagcacacttccctgcctcctttgagatctgcgagcccttgctgcagttcagattcaacaaggccctctgcccaccctctcactaggcctcacccaacaccagtggaactggagcctctggctgggcacagtggctcactttgggaggctgaggcaggaaggctgctggaaactgagagttcaagaccagcctgggcaacatagtgagaccctgtctctacaaatacaaaataaaataattagctgggtgtgttggtgtgtgcctgtggtcccagctactcgggaggctgaggtgggaagatccctgagcctggagggtcgaggttgcagtgagcggagatcgcacctctgcactcaatcctgggtgacaaaatgaaaccctgcctca

SEQ ID NO: 71871 - DNA, 676 bp, Homo sapiens
tcttgctatgtctgctaaagaacgagcatcagcctttcaagcttgacaggcagtgtgatgtgttctgaaagtgtccagggcaaagcgtagggagagggtggatttgtgcagggtgcagctctggagaagaagctggatcactcttgcttaccgggactggggcagctcactaggattctatcctttccaatcggcatcagccagctcttgtcccctgataagtgaggacagcctgaccctggcctcaaatgcagccatccctgagttcatgcgatgctgacgggaccccagcacacttccctgcctcctttgagatctgcgagcccttgctgcagttcagattcaacaaggccctctgcccaccctctcactaggcctcacccaacaccagtggaactggagcctctggctgggcacagtggctcactttgggaggctgaggcaggaaggctgctggaaactgagagttcaagaccagcctgggcaacatagtgagaccctgtctctacaaatacaaaataaaataattagctgggtgtgttggtgtgtgcctgtggtcccagctactcgggaggctgaggtgggaagatccctgagcctggagggtcgaggttgcagtgagcggagatcgcacctctgcactcaatcctgggtgacaaaatgaaaccctgcctca

SEQ ID NO: 71872 - DNA, 458 bp, Homo sapiens
cccgttcaccagcttgggttcagatgaagctcccccgacagccactactcctgtgctgttgcaggctattgtaacgggggttccacgtcatccaggccacaggccaagccttggatgcacctgctctttgcccagctgccccagggcagagctctgcacagatcacagtgccttaagacaggatgataacacccctcagtgttttccttagagtgctccatgcaccacagccatttttcaaagcatcccccaggccagggttaaggcagaacaggttttccagtcatagcctcccacttagctgagtaacatttcttgagtgatcttgtaaatgaatagtttgaaagaaaaacaggcaactaaggcagtgcggtcacattgtttgagaatacagatgcaaaattacttgtgaatttacttgctcatttttccaaaggatgtaatctgtacacttagaa

SEQ ID NO: 71873 - DNA, 553 bp, Homo sapiens
acttggagtgagccaggcggagggggcagcaggacggagccttccagtcaggaggtgcccggagtgtcacggggagaggccattgtgagcaaaacagcaaggagggggatgcaggagaaggaaccagtgccccccagctgggggccacccaggaaggacgtgggcttctctcaggagagagggaatcgcggaagttacagcaagaaggtctataacccgactcaggttgtcttccgtgttggggtagactgtggaggcgagacgctgtgagagcagtcaggaaggagatgcttcagctgggtcacagctcggtgcagccaggggcagcggggtggagtcagcgacagaccagagaaggatcaagtacgaatccagggtttgagtcctgaacagctggaaaggcagagttgctgtcagttgagctgggtgaggttctggcttgcgggttaggggcacatccgttagaaaacagcattgctgaggaagcacagtgagctccgaggcaaaccctttttctttcaacctgcggtttgcatcccagagccagcctaac

SEQ ID NO: 71874 - DNA, 752 bp, Homo sapiens
actgtggttctgcgcttgtcatcatggcgacgcggggccatgtgcaggaccctaacgacaggcgcctccggcccatttacgattatcttgacaatggtaataataaaatggcaattcagcaagcagataaactgttgaagaaacataaggatcttcattgtgctaaggttttaaaggcaattggtttacagagaactggaaagcaagaggaagcctttactcttgcacaggaggtggcagcccttgaacccacagatgacaactcactgcaggcactgactatcctttaccgggagatgcaccgaccggagttagttacaaaactttatgaggcagctgtgaagaaagttcccaatagtgaggagtatcactctcacctcttcatggcctatgccagagtgggtgaatacaagaaaatgcaacaggctggcatggctctatataagattgtccccaaaaatccctactacttttggtctgtgatgagcttaattatgcaatctatatcggcacaggatgaaaacctctcaaaaacaatgtttctgccccttgctgagagaatggtcgaaaaaatggtgaaagaggacaagatagaagctgaggctgaatttgatagctgggtcctcacttttggcctttgggtaaatctgaagccctcagcgtaggtctaatcactgacctgtttccagcaagtactctaggctgagatgtgtatagacgggagagatatagatggagaagatcctgttacc

SEQ ID NO: 71875 - DNA, 807 bp, Homo sapiens
atggctttttaaagaacttacaatggatagtctatcctttggagtttggttcattatggaaaatgaaaaacaaatagctttctaaattaaatttttatttgcttattctttatttgtgtgttgtgttccttaaaatagcattgaaacaaaagctgaataaaactaaaatgttttttgttttcagatgtcttcagtaaatgtaaaggtgacctcttagaagttaaagatggtaacttgaaaacacatcctactcttttagaaaatctagttttctttgttgaggtaagtttttgttctcttcctaaaagacattgttgttcttaatggtctacaggattcatttttcaacagtgaacaggtaataggcaccttatacctgtaacttaaccctccatccctgtttttgttaattgaaaagcaatttaaatcattttctaaaccaatttcttccaagaattctaagatgatttcattcataatacttaggtaaaacttcttgaaatttgctgtactcatctctaaacttccccagattcacctcaaatctagctgttttcattctcctttctgactcactctttattatgtagtttaattcctccagcttcttttatttgttgtcatttattaattgctaagatattatgcattgtgatagtgtccagcaactgatacagcaaaactccctcctctttttttgccagagggaagagaaggaagattgcaaacactcataatctattatcttttcttttatttctgtcacatatttgttgactgttctccccttactactctgtgtgggga

SEQ ID NO: 71876 - DNA, 631 bp, Homo sapiens
tccttctttccttctgatctagttatcttttgacccgatatgctgaatctctaggtcagtatgctgctgcgtcccaatcctgtaacttcgcactcaggttttttcactccaaccagaaagatgtaagtgaaaaactattttttaactgtgatcttgtctgctgactgcacactattgaggagcacgtcaccacatgtcacaagtacacatgttaaggtgcaccatgctgaactagcaagtgcccttagaccaaagcttactgtccaaggctggtagggagaggtagagagttatttgtgtttgttagaatgggcgtgtttaatagaatccttggaaagttgcatttaaaaactggtatttactgactaggaagtgttagtcctcttagacctggcttttaatctctaagagacttttccaagggtataagaaacagtccataagcgttcatagcctgggatgccgtgtaacatcctgcaatagcagctgctctctgttacttttatttaactctgaaatgtatgtccattgtgctctttgccaaaggtgaatgtacttgtattttcttagaaaattaaaaggcattccgagaaacctaggtgaataatatgttttttaaagtagcaataaa

SEQ ID NO: 71877 - DNA, 509 bp, Homo sapiens
cacgcccagctaatttttgtatttttagtagagatggggtttctccatgttggctcagctagtctcgaactcctgacctcagatgatctgccagcctcggcctcccaaagtgatgggattacaggcatgagccattgcgcctggcccaggacatttatttttatttggataatgctgtattttggttctaggtgatgagaccactgtgtggcaggccctgactttgctggaagagggattaacccatagcccttccaatgctcagttcaaattgctgcttgttcgaatctactgtatgctgggtgcatttgaaccagtggtggatctttactccagcctcgatgctaagcatatccagcatgataccattgggttggtagtatatactctgaataatgagcagccagctataccagtgtggggtacacaggactctaacttagattttaaagttgattgtgacattaagcctttctgattaaataataacctgttatgatccattgcaa

SEQ ID NO: 71878 - DNA, 5634 bp, Homo sapiens
actgtggttctgcgcttgtcatcatggcgacgcggggccatgtgcaggaccctaacgacaggcgcctccggcccatttacgattatcttgacaatggtaataataaaatggcaattcagcaagcagataaactgttgaagaaacataaggatcttcattgtgctaaggttttaaaggcaattggtttacagagaactggaaagcaagaggaagcctttactcttgcacaggaggtggcagcccttgaacccacagatgacaactcactgcaggcactgactatcctttaccgggagatgcaccgaccggagttagttacaaaactttatgaggcagctgtgaagaaagttcccaatagtgaggagtatcactctcacctcttcatggcctatgccagagtgggtgaatacaagaaaatgcaacaggctggcatggctctatataagattgtccccaaaaatccctactacttttggtctgtgatgagcttaattatgcaatctatatcggcacaggatgaaaacctctcaaaaacaatgtttctgccccttgctgagagaatggtcgaaaaaatggtgaaagaggacaagatagaagctgaggctgaagttgaactttattatatgatcctggaacgtttgggaaagtaccaggaggccttggatgtcatcagagggaaattaggagagaagttgacaagtgagattcagagtcgggaaaataaatgcatggctatgtacaagaagctgagcaggtggccagagtgcaatgccctttcccggcgcctcttactaaaaaactcagatgactggcagttctatctgacttatttcgattctgtctttcgactgattgaagaggcctggagtcctcctgctgaaggtgaacactctttagaaggagaagtacattattctgcagaaaaagctgtgaagtttatagaagatcggataacggaagaatctaaaagttctcgccatctccgaggaccacatctagctaaattggagctgattaggcgtttacgaagtcaaggttgtaacgatgagtacaaactgggtgatccagaagaattaatgttccagtattttaaaaagtttggcgataaaccttgttgttttacagaccttaaggtgtttgttgacctcttacctgctacacagtgtacaaaatttattaatcagttacttggagttgttcctttgtcgacaccaacagaggataagctggcactgcctgctgacatcagagctctgcagcaacatttgtgtgtggtgcagctgacgaggttacttggcttgtaccacaccatggataaaaatcagaaattgagtgtggtcagagaattgatgttaaggtaccagcatggactggaatttgggaaaacctgtttgaaaacagaattgcaattttctgactattactgtctccttgctgtccatgcgcttattgatgtatggagggaaacaggtgatgagaccactgtgtggcaggccctgactttgctggaagagggattaacccatagcccttccaatgctcagttcaaattgctgcttgttcgaatctactgtatgctgggtgcatttgaaccagtggtggatctttactccagcctcgatgctaagcatatccagcatgataccattggttatcttttgacccgatatgctgaatctctaggtcagtatgctgctgcgtcccaatcctgtaacttcgcactcaggttttttcactccaaccagaaagatacctcagaatatattattcaagcttacaaatatggtgcatttgagaagatcccagagtttatcgcttttaggaacaggctgaataattctcttcattttgcacaagtccgtactgaacggatgctgttagaccttctacttgaagcaaatatatcaaccagtttagcagaaagtataaagtcaatgaaccttaggccagaagaagatgacattccatgggaagatttgcgagacaacagagacttaaatgtttttttcagctgggatccaaaagacagggacgtttctgaagaacataagaaactttccttagaggaggagaccttgtggttaagaatccgatccttaacattgaggctgataagtggacttccaagtctcaaccaccctgtggagccaaagaactcggagaagactgccgagaatggggtatcctcccggattgatattcttcgtttgctccttcaacagctggaggcaaccctggagacaggaaagcgatttattgagaaggatattcagtatcctttccttggtcctgtacctaccagaatgggtggattctttaattctggctgttctcagtgccagataagctctttttatcttgtcaatgatatttatgagctggataccagtggtttagaggatacaatggagattcaggaacgaatagaaaatagttttaagtctttactagaccagttaaaagatgtcttcagtaaatgtaaaggtgacctcttagaagttaaagatggtaacttgaaaacacatcctactcttttagaaaatctagttttctttgttgagactatttctgttatcctttgggtatccagttactgtgagagtgtcctacgaccatacaaactaaatttacagaaaaagaaaaagaagaaaaaagaaaccagcatcatcatgccacctgtctttaccagtttccaagactatgttactgggcttcagactttaatttccaatgttgtggatcatattaaagggcttgaaacacatctaattgcacttaaacttgaagaacttattttagaagacacttctctctcaccggaagagagaaaattttcaaagactgtgcaagggaaggtgcagagcagttatctgcactcacttctggaaatgggggagctgctgaaaaaaagacttgagaccacaaagaaactaaaaatttaaggaagtatctatcatgggcactgatgactctgcaacagaatatgacaccatcttcccaggcaaaagcaacatctggttgaccatgattttaatccagaacttcctcataaaatgcatgaaggactttgatcgtgaatttttttaggtgttaaatatatacaactgattaaattattgtatataaaccagaagcgggaccctcatctgggtttgaccactttttatacatgttcatatgcatatggcagcaacaagagaaccctacttttcttcttcccatcaccagaaacatcttttcaggggagcggggggtctataaaaacagcaatagaaattaagcataaagcatcaacctcatagcaactgaatagcccttccattataaataacattgagagtttttggtctggtccttgagccacaagaagtggaggggagaccatgcctgggaacagacccccttttcacagcagtaagtttgttttgaggctttctcagctacttggctcccacagaacccaaggcaggtacacaaaggaccttagatgagatctggcatatgcacccgcaatagaagggcaccacttggatgaccacaggcacttagtttttggctagtttttgtctgatagttaagacatccccatcctagcttctgtgagagttaaaaatctcaggtaagaaggcaaggaaggctctgttaatttatagctgtttagaggggaaagcagtgcagaccacttattaagcccgctgaggactagctttctgtctttcatacatttgggaaagataggaatgactgtttcaaagaagagaggtgcacataatttatgcaggcaagtatgatacttatttcattggttttgtgagtcatatatatacatatatatatatacacatatatatatgacttgaaaattaagatttaatactttaatgttttaagtgtggggggtttgggaaggaaggaatgtaatattatggatttagccttaggctttaagttttaggctggcaaaagaaatgttattcagtgggtttgaggtttggactactttcttcaaacttagagaattataacaggatggtgtttactttgttcacctggatgtccccaagactctagcttcttctatcagtggttggtctgatagaagaggtaaaaattgctcttgaaaatgtcctacaatttatgcagtttctttgataatatttttctgtttaaatccctgcttctgtttttggtctgttacctaaatatagttcaagtttaattctgtaagagcaaagaaatgaatttgatgaggaaattaagcatccaatggaggattggtcttgaagaccttaaaggtgctttccaacctgcactgctccagtgaaatgtggtacttttttcttttaaaagcaaccaagagagctgggaatatctgtgtacgcaaagtaattgcattttgtcccttcattttgactttcttagattcataatttgatacagtgcttaaacttccaaggaaattttaaacaattactacattacctgttcaaaataaggcttgttggaaatcctagtccatcaactaatttcaaaaatttatttttgatatgagtagcaacagctggtcatataccctatcccaaaaggaagaactgtcttgaacaagatgaatggaaaattgtggttaattctgaatttcatgtaatgacaacatattctttcataaaactatggcctgtttaagatggaactttgtgtgtgtctgctggggagggtggggtacatgtgtatggcgtgtgttcttgaaatgatgtctctctgaatatccaaaaaagtactgtactgtagaaatgctctttgaaaaagtctatcgactgaccatgatcaatctagcatatgtatgttcagtgggctagccttggtcctcagggacagtgtgtgactctagtggtcttcctaaccagtctcttgcctaaagatatctgggacctctactggctttaatgacaaataatgttatgttgaggttatgcttcctttgttatttgctgattttcctactaaatgtagcatttcaattagatccagctttcacattttgagataattgtaaaaagaatgaaattatgcagaaatggccaatatctcttatcaatctgttcttttggaaaccctcatgtactataaattgtgtacagttaaaaaaatatatatatatatatattcttacatgagtaaaaagcaccctctcccagcaatcgtatgccattggtatttgaagagaattcccaaataacccattgctgctgctgctgtttttgatttgtatgggtttttttgttttgtttgtttttgtgtggtaaactgatatttaaaaaaggaaaggagaaaaatcacgactactgtttacagactgaaaaattattgctttttatactactgagatcctaagttaagactctccaaagcaaacatttggtttaaatcatttatctgatgtagataaaaggtagagaaacttgtagtgttctccacataatggaaaatgtacaaatgcctagttgtgttgcccatcaattttgtatattttcataattttaattgttgaaaattgcattatattttgcaatcactatgttcaatctggatttgtctttcattttaacttttaatataaaaaggggtttcaatgta

SEQ ID NO: 71879 - DNA, 5790 bp, Homo sapiens
actgtggttctgcgcttgtcatcatggcgacgcggggccatgtgcaggaccctaacgacaggcgcctccggcccatttacgattatcttgacaatggtaataataaaatggcaattcagcaagcagataaactgttgaagaaacataaggatcttcattgtgctaaggttttaaaggcaattggtttacagagaactggaaagcaagaggaagcctttactcttgcacaggaggtggcagcccttgaacccacagatgacaactcactgcaggcactgactatcctttaccgggagatgcaccgaccggagttagttacaaaactttatgaggcagctgtgaagaaagttcccaatagtgaggagtatcactctcacctcttcatggcctatgccagagtgggtgaatacaagaaaatgcaacaggctggcatggctctatataagattgtccccaaaaatccctactacttttggtctgtgatgagcttaattatgcaatctatatcggcacaggatgaaaacctctcaaaaacaatgtttctgccccttgctgagagaatggtcgaaaaaatggtgaaagaggacaagatagaagctgaggctgaagttgaactttattatatgatcctggaacgtttgggaaagtaccaggaggccttggatgtcatcagagggaaattaggagagaagttgacaagtgagattcagagtcgggaaaataaatgcatggctatgtacaagaagctgagcaggtggccagagtgcaatgccctttcccggcgcctcttactaaaaaactcagatgactggcagttctatctgacttatttcgattctgtctttcgactgattgaagaggcctggagtcctcctgctgaaggtgaacactctttagaaggagaagtacattattctgcagaaaaagctgtgaagtttatagaagatcggataacggaagaatctaaaagttctcgccatctccgaggaccacatctagctaaattggagctgattaggcgtttacgaagtcaaggttgtaacgatgagtacaaactgggtgatccagaagaattaatgttccagtattttaaaaagtttggcgataaaccttgttgttttacagaccttaaggtgtttgttgacctcttacctgctacacagtgtacaaaatttattaatcagttacttggagttgttcctttgtcgacaccaacagaggataagctggcactgcctgctgacatcagagctctgcagcaacatttgtgtgtggtgcagctgacgaggttacttggcttgtaccacaccatggataaaaatcagaaattgagtgtggtcagagaattgatgttaaggtaccagcatggactggaatttgggaaaacctgtttgaaaacagaattgcaattttctgactattactgtctccttgctgtccatgcgcttattgatgtatggagggaaacaggtgatgagaccactgtgtggcaggccctgactttgctggaagagggattaacccatagcccttccaatgctcagttcaaattgctgcttgttcgaatctactgtatgctgggtgcatttgaaccagtggtggatctttactccagcctcgatgctaagcatatccagcatgataccattggttatcttttgacccgatatgctgaatctctaggtcagtatgctgctgcgtcccaatcctgtaacttcgcactcaggttttttcactccaaccagaaagatacctcagaatatattattcaagcttacaaatatggtgcatttgagaagatcccagagtttatcgcttttaggaacaggctgaataattctcttcattttgcacaagtccgtactgaacggatgctgttagaccttctacttgaagcaaatatatcaaccagtttagcagaaagtataaagtcaatgaaccttaggccagaagaagatgacattccatgggaagatttgcgagacaacagagacttaaatgtttttttcagctgggatccaaaagacagggacgtttctgaagaacataagaaactttccttagaggaggagaccttgtggttaagaatccgatccttaacattgaggctgataagtggacttccaagtctcaaccaccctgtggagccaaagaactcggagaagactgccgagaatggggtatcctcccggattgatattcttcgtttgctccttcaacagctggaggcaaccctggagacaggaaagcgatttattgagaaggatattcagtatcctttccttggtcctgtacctaccagaatgggtggattctttaattctggctgttctcagtgccagataagctctttttatcttgtcaatgatatttatgagctggataccagtggtttagaggatacaatggagattcaggaacgaatagaaaatagttttaagtctttactagaccagttaaaagatgtcttcagtaaatgtaaaggtgacctcttagaagttaaagatggtaacttgaaaacacatcctactcttttagaaaatctagttttctttgttgagactatttctgttatcctttgggtatccagttactgtgagagtgtcctacgaccatacaaactaaatttacagaaaaagaaaaagaagaaaaaagaaaccagcatcatcatgccacctgtctttaccagtttccaagactatgttactgggcttcagactttaatttccaatgttgtggatcatattaaagggcttgaaacacatctaattgcacttaaacttgaagaacttattttagaagacacttctctctcaccggaagagagaaaattttcaaagactgtgcaagggaaggtgcagagcagttatctgcactcacttctggaaatgggggagctgctgaaaaaaagacttgagaccacaaagaaactaaaaatttaaggaagtatctatcatgggcactgatgactctgcaacagaatatgacaccatcttcccaggcaaaagcaacatctggttgaccatgattttaatccagaacttcctcataaaatgcatgaaggactttgatcgtgaatttttttaggtgttaaatatatacaactgattaaattattgtatataaaccagaagcgggaccctcatctgggtttgaccactttttatacatgttcatatgcatatggcagcaacaagagaaccctacttttcttcttcccatcaccagaaacatcttttcaggggagcggggggtctataaaaacagcaatagaaattaagcataaagcatcaacctcatagcaactgaatagcccttccattataaataacattgagagtttttggtctggtccttgagccacaagaagtggaggggagaccatgcctgggaacagacccccttttcacagcagtaagtttgttttgaggctttctcagctacttggctcccacagaacccaaggcaggtacacaaaggaccttagatgagatctggcatatgcacccgcaatagaagggcaccacttggatgaccacaggcacttagtttttggctagtttttgtctgatagttaagacatccccatcctagcttctgtgagagttaaaaatctcaggtaagaaggcaaggaaggctctgttaatttatagctgtttagaggggaaagcagtgcagaccacttattaagcccgctgaggactagctttctgtctttcatacatttgggaaagataggaatgactgtttcaaagaagagaggtgcacataatttatgcaggcaagtatgatacttatttcattggttttgtgagtcatatatatacatatatatatatacacatatatatatgacttgaaaattaagatttaatactttaatgttttaagtgtggggggtttgggaaggaaggaatgtaatattatggatttagccttaggctttaagttttaggctggcaaaagaaatgttattcagtgggtttgaggtttggactactttcttcaaacttagagaattataacaggatggtgtttactttgttcacctggatgtccccaagactctagcttcttctatcagtggttggtctgatagaagaggtaaaaattgctcttgaaaatgtcctacaatttatgcagtttctttgataatatttttctgtttaaatccctgcttctgtttttggtctgttacctaaatatagttcaagtttaattctgtaagagcaaagaaatgaatttgatgaggaaattaagcatccaatggaggattggtcttgaagaccttaaaggtgctttccaacctgcactgctccagtgaaatgtggtacttttttcttttaaaagcaaccaagagagctgggaatatctgtgtacgcaaagtaattgcattttgtcccttcattttgactttcttagattcataatttgatacagtgcttaaacttccaaggaaattttaaacaattactacattacctgttcaaaataaggcttgttggaaatcctagtccatcaactaatttcaaaaatttatttttgatatgagtagcaacagctggtcatataccctatcccaaaaggaagaactgtcttgaacaagatgaatggaaaattgtggttaattctgaatttcatgtaatgacaacatattctttcataaaactatggcctgtttaagatggaactttgtgtgtgtctgctggggagggtggggtacatgtgtatggcgtgtgttcttgaaatgatgtctctctgaatatccaaaaaagtactgtactgtagaaatgctctttgaaaaagtctatcgactgaccatgatcaatctagcatatgtatgttcagtgggctagccttggtcctcagggacagtgtgtgactctagtggtcttcctaaccagtctcttgcctaaagatatctgggacctctactggctttaatgacaaataatgttatgttgaggttatgcttcctttgttatttgctgattttcctactaaatgtagcatttcaattagatccagctttcacattttgagataattgtaaaaagaatgaaattatgcagaaatggccaatatctcttatcaatctgttcttttggaaaccctcatgtactataaattgtgtacagttaaaaaaatatatatatatatatattcttacatgagtaaaaagcaccctctcccagcaatcgtatgccattggtatttgaagagaattcccaaataacccattgctgctgctgctgtttttgatttgtatgggtttttttgttttgtttgtttttgtgtggtaaactgatatttaaaaaaggaaaggagaaaaatcacgactactgtttacagactgaaaaattattgctttttatactactgagatcctaagttaagactctccaaagcaaacatttggtttaaatcatttatctgatgtagataaaaggtagagaaacttgtagtgttctccacataatggaaaatgtacaaatgcctagttgtgttgcccatcaattttgtatattttcataattttaattgttgaaaattgcattatattttgcaatcactatgttcaatctggatttgtctttcattttaacttttaatataaaaaggggtttcaatgtatctacaggcttgttattgaaacttcctacttatttgatgtgatttattaatataggaagtatatattcttccttaagtaagtgaagcatagcaaatctactttaaactggatgggttaatttatataaacattttcattttaagttggcatttctg

SEQ ID NO: 71880 - DNA, 5580 bp, Homo sapiens
actgtggttctgcgcttgtcatcatggcgacgcggggccatgtgcaggaccctaacgacaggcgcctccggcccatttacgattatcttgacaatggtaataataaaatggcaattcagcaagcagataaactgttgaagaaacataaggatcttcattgtgctaaggttttaaaggcaattggtttacagagaactggaaagcaagaggaagcctttactcttgcacaggaggtggcagcccttgaacccacagatgacaactcactgcaggcactgactatcctttaccgggagatgcaccgaccggagttagttacaaaactttatgaggcagctgtgaagaaagttcccaatagtgaggagtatcactctcacctcttcatggcctatgccagagtgggtgaatacaagaaaatgcaacaggctggcatggctctatataagattgtccccaaaaatccctactacttttggtctgtgatgagcttaattatgcaatctatatcggcacaggatgaaaacctctcaaaaacaatgtttctgccccttgctgagagaatggtcgaaaaaatggtgaaagaggacaagatagaagctgaggctgaagttgaactttattatatgatcctggaacgtttgggaaagtaccaggaggccttggatgtcatcagagggaaattaggagagaagttgacaagtgagattcagagtcgggaaaataaatgcatggctatgtacaagaagctgagcaggtggccagagtgcaatgccctttcccggcgcctcttactaaaaaactcagatgactggcagttctatctgacttatttcgattctgtctttcgactgattgaagaggcctggagtcctcctgctgaaggtgaacactctttagaaggagaagtacattattctgcagaaaaagctgtgaagtttatagaagatcggataacggaagaatctaaaagttctcgccatctccgaggaccacatctagctaaattggagctgattaggcgtttacgaagtcaaggttgtaacgatgagtacaaactgggtgatccagaagaattaatgttccagtattttaaaaagtttggcgataaaccttgttgttttacagaccttaaggtgtttgttgacctcttacctgctacacagtgtacaaaatttattaatcagttacttggagttgttcctttgtcgacaccaacagaggataagctggcactgcctgctgacatcagagctctgcagcaacatttgtgtgtggtgcagctgacgaggttacttggcttgtaccacaccatggataaaaatcagaaattgagtgtggtcagagaattgatgttaaggtaccagcatggactggaatttgggaaaacctgtttgaaaacagaattgcaattttctgactattactgtctccttgctgtccatgcgcttattgatgtatggagggaaacaggtgatgagaccactgtgtggcaggccctgactttgctggaagagggattaacccatagcccttccaatgctcagttcaaattgctgcttgttcgaatctactgtatgctgggtgcatttgaaccagtggtggatctttactccagcctcgatgctaagcatatccagcatgataccattggttatcttttgacccgatatgctgaatctctaggtcagtatgctgctgcgtcccaatcctgtaacttcgcactcaggttttttcactccaaccagaaagatacctcagaatatattattcaagcttacaaatatggtgcatttgagaagatcccagagtttatcgcttttaggaacaggctgaataattctcttcattttgcacaagtccgtactgaacggatgctgttagaccttctacttgaagcaaatatatcaaccagtttagcagaaagtataaagtcaatgaaccttaggccagaagaagatgacattccatgggaagatttgcgagacaacagagacttaaatgtttttttcagctgggatccaaaagacagggacgtttctgaagaacataagaaactttccttagaggaggagaccttgtggttaagaatccgatccttaacattgaggctgataagtggacttccaagtctcaaccaccctgtggagccaaagaactcggagaagactgccgagaatggggtatcctcccggattgatattcttcgtttgctccttcaacagctggaggcaaccctggagacaggaaagcgatttattgagaaggatattcagtatcctttccttggtcctgtacctaccagaatgggtggattctttaattctggctgttctcagtgccagataagctctttttatcttgtcaatgatatttatgagctggataccagtggtttagaggatacaatggagattcaggaacgaatagaaaatagttttaagtctttactagaccagttaaaagatgtcttcagtaaatgtaaaggtgacctcttagaagttaaagatggtaacttgaaaacacatcctactcttttagaaaatctagttttctttgttgagactatttctgttatcctttgggtatccagttactgtgagagtgtcctacgaccatacaaactaaatttacagaaaaagaaaaagaagaaaaaagaaaccagcatcatcatgccacctgtctttaccagtttccaagactatgttactgggcttcagactttaatttccaatgttgtggatcatattaaagggcttgaaacacatctaattgcacttaaacttgaagaacttattttagaagacacttctctctcaccggaagagagaaaattttcaaagactgtgcaagggaaggtgcagagcagttatctgcactcacttctggaaatgggggagctgctgaaaaaaagacttgagaccacaaagaaactaaaaatttaaggaagtatctatcatgggcactgatgactctgcaacagaatatgacaccatcttcccaggcaaaagcaacatctggttgaccatgattttaatccagaacttcctcataaaatgcatgaaggactttgatcgtgaatttttttaggtgttaaatatatacaactgattaaattattgtatataaaccagaagcgggaccctcatctgggtttgaccactttttatacatgttcatatgcatatggcagcaacaagagaaccctacttttcttcttcccatcaccagaaacatcttttcaggggagcggggggtctataaaaacagcaatagaaattaagcataaagcatcaacctcatagcaactgaatagcccttccattataaataacattgagagtttttggtctggtccttgagccacaagaagtggaggggagaccatgcctgggaacagacccccttttcacagcagtaagtttgttttgaggctttctcagctacttggctcccacagaacccaaggcaggtacacaaaggaccttagatgagatctggcatatgcacccgcaatagaagggcaccacttggatgaccacaggcacttagtttttggctagtttttgtctgatagttaagacatccccatcctagcttctgtgagagttaaaaatctcaggtaagaaggcaaggaaggctctgttaatttatagctgtttagaggggaaagcagtgcagaccacttattaagcccgctgaggactagctttctgtctttcatacatttgggaaagataggaatgactgtttcaaagaagagaggtgcacataatttatgcaggcaagtatgatacttatttcattggttttgtgagtcatatatatacatatatatatatacacatatatatatgacttgaaaattaagatttaatactttaatgttttaagtgtggggggtttgggaaggaaggaatgtaatattatggatttagccttaggctttaagttttaggctggcagaattataacaggatggtgtttactttgttcacctggatgtccccaagactctagcttcttctatcagtggttggtctgatagaagaggtaaaaattgctcttgaaaatgtcctacaatttatgcagtttctttgataatatttttctgtttaaatccctgcttctgtttttggtctgttacctaaatatagttcaagtttaattctgtaagagcaaagaaatgaatttgatgaggaaattaagcatccaatggaggattggtcttgaagaccttaaaggtgctttccaacctgcactgctccagtgaaatgtggtacttttttcttttaaaagcaaccaagagagctgggaatatctgtgtacgcaaagtaattgcattttgtcccttcattttgactttcttagattcataatttgatacagtgcttaaacttccaaggaaattttaaacaattactacattacctgttcaaaataaggcttgttggaaatcctagtccatcaactaatttcaaaaatttatttttgatatgagtagcaacagctggtcatataccctatcccaaaaggaagaactgtcttgaacaagatgaatggaaaattgtggttaattctgaatttcatgtaatgacaacatattctttcataaaactatggcctgtttaagatggaactttgtgtgtgtctgctggggagggtggggtacatgtgtatggcgtgtgttcttgaaatgatgtctctctgaatatccaaaaaagtactgtactgtagaaatgctctttgaaaaagtctatcgactgaccatgatcaatctagcatatgtatgttcagtgggctagccttggtcctcagggacagtgtgtgactctagtggtcttcctaaccagtctcttgcctaaagatatctgggacctctactggctttaatgacaaataatgttatgttgaggttatgcttcctttgttatttgctgattttcctactaaatgtagcatttcaattagatccagctttcacattttgagataattgtaaaaagaatgaaattatgcagaaatggccaatatctcttatcaatctgttcttttggaaaccctcatgtactataaattgtgtacagttaaaaaaatatatatatatatatattcttacatgagtaaaaagcaccctctcccagcaatcgtatgccattggtatttgaagagaattcccaaataacccattgctgctgctgctgtttttgatttgtatgggtttttttgttttgtttgtttttgtgtggtaaactgatatttaaaaaaggaaaggagaaaaatcacgactactgtttacagactgaaaaattattgctttttatactactgagatcctaagttaagactctccaaagcaaacatttggtttaaatcatttatctgatgtagataaaaggtagagaaacttgtagtgttctccacataatggaaaatgtacaaatgcctagttgtgttgcccatcaattttgtatattttcataattttaattgttgaaaattgcattatattttgcaatcactatgttcaatctggatttgtctttcattttaacttttaatataaaaaggggtttcaatgta

SEQ ID NO: 71881 - DNA, 5197 bp, Homo sapiens
actgtggttctgcgcttgtcatcatggcgacgcggggccatgtgcaggaccctaacgacaggcgcctccggcccatttacgattatcttgacaatggtaataataaaatggcaattcagcaagcagataaactgttgaagaaacataaggatcttcattgtgctaaggttttaaaggcaattggtttacagagaactggaaagcaagaggaagcctttactcttgcacaggaggtggcagcccttgaacccacagatgacaactcactgcaggcactgactatcctttaccgggagatgcaccgaccggagttagttacaaaactttatgaggcagctgtgaagaaagttcccaatagtgaggagtatcactctcacctcttcatggcctatgccagagtgggtgaatacaagaaaatgcaacaggctggcatggctctatataagattgtccccaaaaatccctactacttttggtctgtgatgagcttaattatgcaatctatatcggcacaggatgaaaacctctcaaaaacaatgtttctgccccttgctgagagaatggtcgaaaaaatggtgaaagaggacaagatagaagctgaggctgaagttgaactttattatatgatcctggaacgtttgggaaagtaccaggaggccttggatgtcatcagagggaaattaggagagaagttgacaagtgagattcagagtcgggaaaataaatgcatggctatgtacaagaagctgagcaggtggccagagtgcaatgccctttcccggcgcctcttactaaaaaactcagatgactggcagttctatctgacttatttcgattctgtctttcgactgattgaagaggcctggagtcctcctgctgaaggtgaacactctttagaaggagaagtacattattctgcagaaaaagctgtgaagtttatagaagatcggataacggaagaatctaaaagttctcgccatctccgaggaccacatctagctaaattggagctgattaggcgtttacgaagtcaaggttgtaacgatgagtacaaactgggtgatccagaagaattaatgttccagtattttaaaaagtttggcgataaaccttgttgttttacagaccttaaggtgtttgttgacctcttacctgctacacagtgtacaaaatttattaatcagttacttggagttgttcctttgtcgacaccaacagaggataagctggcactgcctgctgacatcagagctctgcagcaacatttgtgtgtggtgcagctgacgaggttacttggcttgtaccacaccatggataaaaatcagaaattgagtgtggtcagagaattgatgttaaggtaccagcatggactggaatttgggaaaacctgtttgaaaacagaattgcaattttctgactattactgtctccttgctgtccatgcgcttattgatgtatggagggaaacaggtgatgagaccactgtgtggcaggccctgactttgctggaagagggattaacccatagcccttccaatgctcagttcaaattgctgcttgttcgaatctactgtatgctgggtgcatttgaaccagtggtggatctttactccagcctcgatgctaagcatatccagcatgataccattggttatcttttgacccgatatgctgaatctctaggtcagtatgctgctgcgtcccaatcctgtaacttcgcactcaggttttttcactccaaccagaaagatacctcagaatatattattcaagcttacaaatatggtgcatttgagaagatcccagagtttatcgcttttaggaacaggctgaataattctcttcattttgcacaagtccgtactgaacggatgctgttagaccttctacttgaagcaaatatatcaaccagtttagcagaaagtataaagtcaatgaaccttaggccagaagaagatgacattccatgggaagatttgcgagacaacagagacttaaatgtttttttcagctgggatccaaaagacagggacgtttctgaagaacataagaaactttccttagaggaggagaccttgtggttaagaatccgatccttaacattgaggctgataagtggacttccaagtctcaaccaccctgtggagccaaagaactcggagaagactgccgagaatggggtatcctcccggattgatattcttcgtttgctccttcaacagctggaggcaaccctggagacaggaaagcgatttattgagaaggatattcagtatcctttccttggtcctgtacctaccagaatgggtggattctttaattctggctgttctcagtgccagataagctctttttatcttgtcaatgatatttatgagctggataccagtggtttagaggatacaatggagattcaggaacgaatagaaaatagttttaagtctttactagaccagttaaaagatgtcttcagtaaatgtaaaggtgacctcttagaagttaaagatggtaacttgaaaacacatcctactcttttagaaaatctagttttctttgttgagactatttctgttatcctttgggtatccagttactgtgagagtgtcctacgaccatacaaactaaatttacagaaaaagaaaaagaagaaaaaagaaaccagcatcatcatgccacctgtctttaccagtttccaagactatgttactgggcttcagactttaatttccaatgttgtggatcatattaaagggcttgaaacacatctaattgcacttaaacttgaagaacttattttagaagacacttctctctcaccggaagagagaaaattttcaaagactgtgcaagggaaggtgcagagcagttatctgcactcacttctggaaatgggggagctgctgaaaaaaagacttgagaccacaaagaaactaaaaatttaaggaagtatctatcatgggcactgatgactctgcaacagaatatgacaccatcttcccaggcaaaagcaacatctggttgaccatgattttaatccagaacttcctcataaaatgcatgaaggactttgatcgtgaatttttttaggtgttaaatatatacaactgattaaattattgtatataaaccagaagcgggaccctcatctgggtttgaccactttttatacatgttcatatgcatatggcagcaacaagagaaccctacttttcttcttcccatcaccagaaacatcttttcaggggagcggggggtctataaaaacagcaatagaaattaagcataaagcatcaacctcatagcaactgaatagcccttccattataaataacattgagagtttttggtctggtccttgagccacaagaagtggaggggagaccatgcctgggaacagacccccttttcacagcagtaagtttgttttgaggctttctcagctacttggctcccacagaacccaaggcaggtacacaaaggaccttagatgagatctggcatatgcacccgcaatagaagggcaccacttggatgaccacaggcacttagtttttggctagtttttgtctgatagttaagacatccccatcctagcttctgtgagagttaaaaatctcaggtaagaaggcaaggaaggctctgttaatttatagctgtttagaggggaaagcagtgcagaccacttattaagcccgctgaggactagctttctgtctttcatacatttgggaaagataggaatgactgtttcaaagaagagaggtgcacataatttatgcaggcaagtatgatacttatttcattggttttgtgagtcatatatatacatatatatatatacacatatatatatgacttgaaaattaagatttaatactttaatgttttaagtgtggggggtttgggaaggaaggaatgtaatattatggatttagccttaggctttaagttttaggctggcaaaagaaatgttattcagtgggtttgaggtttggactactttcttcaaacttagagaattataacaggatggtgtttactttgttcacctggatgtccccaagactctagcttcttctatcagtggttggtctgatagaagaggtaaaaattgctcttgaaaatgtcctacaatttatgcagtttctttgataatatttttctgtttaaatccctgcttctgtttttggtctgttacctaaatatagttcaagtttaattctgtaagagcaaagaaatgaatttgatgaggaaattaagcatccaatggaggattggtcttgaagaccttaaaggtgctttccaacctgcactgctccagtgaaatgtggtacttttttcttttaaaagcaaccaagagagctgggaatatctgtgtacgcaaagtaattgcattttgtcccttcattttgactttcttagattcataatttgatacagtgcttaaacttccaaggaaattttaaacaattactacattacctgttcaaaataaggcttgttggaaatcctagtccatcaactaatttcaaaaatttatttttgatatgagtagcaacagctggtcatataccctatcccaaaaggaagaactgtcttgaacaagatgaatggaaaattgtggttaattctgaatttcatgtaatgacaacatattctttcataaaactatggcctgtttaagatggaactttgtgtgtgtctgctggggagggtggggtacatgtgtatggcgtgtgttcttgaaatgatgtctctctgaatatccaaaaaagtactgtactgtagaaatgctctttgaaaaagtctatcgactgaccatgatcaatctagcatatgtatgttcagtgggctagccttggtcctcagggacagtgtgtgactctagtggtcttcctaaccagtctcttgcctaaagatatctgggacctctactggctttaatgacaaataatgttatgttgaggttatgcttcctttgttatttgctgattttcctactaaatgtagcatttcaattagatccagctttcacattttgagataattgtaaaaagaatgaaattatgcagaaatggccaatatctcttatcaatctgttcttttggaaaccctcatgtactataaattgtgtacagttaaaaaaatatatatatatatatattcttacatgagtaaaaagcaccctctcccagca

SEQ ID NO: 71882 - DNA, 5515 bp, Homo sapiens
actgtggttctgcgcttgtcatcatggcgacgcggggccatgtgcaggaccctaacgacaggcgcctccggcccatttacgattatcttgacaatggtaataataaaatggcaattcagcaagcagataaactgttgaagaaacataaggatcttcattgtgctaaggttttaaaggcaattggtttacagagaactggaaagcaagaggaagcctttactcttgcacaggaggtggcagcccttgaacccacagatgacaactcactgcaggcactgactatcctttaccgggagatgcaccgacgctggcatggctctatataagattgtccccaaaaatccctactacttttggtctgtgatgagcttaattatgcaatctatatcggcacaggatgaaaacctctcaaaaacaatgtttctgccccttgctgagagaatggtcgaaaaaatggtgaaagaggacaagatagaagctgaggctgaagttgaactttattatatgatcctggaacgtttgggaaagtaccaggaggccttggatgtcatcagagggaaattaggagagaagttgacaagtgagattcagagtcgggaaaataaatgcatggctatgtacaagaagctgagcaggtggccagagtgcaatgccctttcccggcgcctcttactaaaaaactcagatgactggcagttctatctgacttatttcgattctgtctttcgactgattgaagaggcctggagtcctcctgctgaaggtgaacactctttagaaggagaagtacattattctgcagaaaaagctgtgaagtttatagaagatcggataacggaagaatctaaaagttctcgccatctccgaggaccacatctagctaaattggagctgattaggcgtttacgaagtcaaggttgtaacgatgagtacaaactgggtgatccagaagaattaatgttccagtattttaaaaagtttggcgataaaccttgttgttttacagaccttaaggtgtttgttgacctcttacctgctacacagtgtacaaaatttattaatcagttacttggagttgttcctttgtcgacaccaacagaggataagctggcactgcctgctgacatcagagctctgcagcaacatttgtgtgtggtgcagctgacgaggttacttggcttgtaccacaccatggataaaaatcagaaattgagtgtggtcagagaattgatgttaaggtaccagcatggactggaatttgggaaaacctgtttgaaaacagaattgcaattttctgactattactgtctccttgctgtccatgcgcttattgatgtatggagggaaacaggtgatgagaccactgtgtggcaggccctgactttgctggaagagggattaacccatagcccttccaatgctcagttcaaattgctgcttgttcgaatctactgtatgctgggtgcatttgaaccagtggtggatctttactccagcctcgatgctaagcatatccagcatgataccattggttatcttttgacccgatatgctgaatctctaggtcagtatgctgctgcgtcccaatcctgtaacttcgcactcaggttttttcactccaaccagaaagatacctcagaatatattattcaagcttacaaatatggtgcatttgagaagatcccagagtttatcgcttttaggaacaggctgaataattctcttcattttgcacaagtccgtactgaacggatgctgttagaccttctacttgaagcaaatatatcaaccagtttagcagaaagtataaagtcaatgaaccttaggccagaagaagatgacattccatgggaagatttgcgagacaacagagacttaaatgtttttttcagctgggatccaaaagacagggacgtttctgaagaacataagaaactttccttagaggaggagaccttgtggttaagaatccgatccttaacattgaggctgataagtggacttccaagtctcaaccaccctgtggagccaaagaactcggagaagactgccgagaatggggtatcctcccggattgatattcttcgtttgctccttcaacagctggaggcaaccctggagacaggaaagcgatttattgagaaggatattcagtatcctttccttggtcctgtacctaccagaatgggtggattctttaattctggctgttctcagtgccagataagctctttttatcttgtcaatgatatttatgagctggataccagtggtttagaggatacaatggagattcaggaacgaatagaaaatagttttaagtctttactagaccagttaaaagatgtcttcagtaaatgtaaaggtgacctcttagaagttaaagatggtaacttgaaaacacatcctactcttttagaaaatctagttttctttgttgagactatttctgttatcctttgggtatccagttactgtgagagtgtcctacgaccatacaaactaaatttacagaaaaagaaaaagaagaaaaaagaaaccagcatcatcatgccacctgtctttaccagtttccaagactatgttactgggcttcagactttaatttccaatgttgtggatcatattaaagggcttgaaacacatctaattgcacttaaacttgaagaacttattttagaagacacttctctctcaccggaagagagaaaattttcaaagactgtgcaagggaaggtgcagagcagttatctgcactcacttctggaaatgggggagctgctgaaaaaaagacttgagaccacaaagaaactaaaaatttaaggaagtatctatcatgggcactgatgactctgcaacagaatatgacaccatcttcccaggcaaaagcaacatctggttgaccatgattttaatccagaacttcctcataaaatgcatgaaggactttgatcgtgaatttttttaggtgttaaatatatacaactgattaaattattgtatataaaccagaagcgggaccctcatctgggtttgaccactttttatacatgttcatatgcatatggcagcaacaagagaaccctacttttcttcttcccatcaccagaaacatcttttcaggggagcggggggtctataaaaacagcaatagaaattaagcataaagcatcaacctcatagcaactgaatagcccttccattataaataacattgagagtttttggtctggtccttgagccacaagaagtggaggggagaccatgcctgggaacagacccccttttcacagcagtaagtttgttttgaggctttctcagctacttggctcccacagaacccaaggcaggtacacaaaggaccttagatgagatctggcatatgcacccgcaatagaagggcaccacttggatgaccacaggcacttagtttttggctagtttttgtctgatagttaagacatccccatcctagcttctgtgagagttaaaaatctcaggtaagaaggcaaggaaggctctgttaatttatagctgtttagaggggaaagcagtgcagaccacttattaagcccgctgaggactagctttctgtctttcatacatttgggaaagataggaatgactgtttcaaagaagagaggtgcacataatttatgcaggcaagtatgatacttatttcattggttttgtgagtcatatatatacatatatatatatacacatatatatatgacttgaaaattaagatttaatactttaatgttttaagtgtggggggtttgggaaggaaggaatgtaatattatggatttagccttaggctttaagttttaggctggcaaaagaaatgttattcagtgggtttgaggtttggactactttcttcaaacttagagaattataacaggatggtgtttactttgttcacctggatgtccccaagactctagcttcttctatcagtggttggtctgatagaagaggtaaaaattgctcttgaaaatgtcctacaatttatgcagtttctttgataatatttttctgtttaaatccctgcttctgtttttggtctgttacctaaatatagttcaagtttaattctgtaagagcaaagaaatgaatttgatgaggaaattaagcatccaatggaggattggtcttgaagaccttaaaggtgctttccaacctgcactgctccagtgaaatgtggtacttttttcttttaaaagcaaccaagagagctgggaatatctgtgtacgcaaagtaattgcattttgtcccttcattttgactttcttagattcataatttgatacagtgcttaaacttccaaggaaattttaaacaattactacattacctgttcaaaataaggcttgttggaaatcctagtccatcaactaatttcaaaaatttatttttgatatgagtagcaacagctggtcatataccctatcccaaaaggaagaactgtcttgaacaagatgaatggaaaattgtggttaattctgaatttcatgtaatgacaacatattctttcataaaactatggcctgtttaagatggaactttgtgtgtgtctgctggggagggtggggtacatgtgtatggcgtgtgttcttgaaatgatgtctctctgaatatccaaaaaagtactgtactgtagaaatgctctttgaaaaagtctatcgactgaccatgatcaatctagcatatgtatgttcagtgggctagccttggtcctcagggacagtgtgtgactctagtggtcttcctaaccagtctcttgcctaaagatatctgggacctctactggctttaatgacaaataatgttatgttgaggttatgcttcctttgttatttgctgattttcctactaaatgtagcatttcaattagatccagctttcacattttgagataattgtaaaaagaatgaaattatgcagaaatggccaatatctcttatcaatctgttcttttggaaaccctcatgtactataaattgtgtacagttaaaaaaatatatatatatatatattcttacatgagtaaaaagcaccctctcccagcaatcgtatgccattggtatttgaagagaattcccaaataacccattgctgctgctgctgtttttgatttgtatgggtttttttgttttgtttgtttttgtgtggtaaactgatatttaaaaaaggaaaggagaaaaatcacgactactgtttacagactgaaaaattattgctttttatactactgagatcctaagttaagactctccaaagcaaacatttggtttaaatcatttatctgatgtagataaaaggtagagaaacttgtagtgttctccacataatggaaaatgtacaaatgcctagttgtgttgcccatcaattttgtatattttcataattttaattgttgaaaattgcattatattttgcaatcactatgttcaatctggatttgtctttcattttaacttttaatataaaaaggggtttcaatgta

SEQ ID NO: 71883 - DNA, 4867 bp, Homo sapiens
taacgctagtacgagccggcggtgaaattcggctcagatgactggcagttctatctgacttatttcgattctgtctttcgactgattgaagaggcctggagtcctcctgctgaaggtgaacactctttagaaggagaagtacattattctgcagaaaaagctgtgaagtttatagaagatcggataacggaagaatctaaaagttctcgccatctccgaggaccacatctagctaaattggagctgattaggcgtttacgaagtcaaggttgtaacgatgagtacaaactgggtgatccagaagaattaatgttccagtattttaaaaagtttggcgataaaccttgttgttttacagaccttaaggtgtttgttgacctcttacctgctacacagtgtacaaaatttattaatcagttacttggagttgttcctttgtcgacaccaacagaggataagctggcactgcctgctgacatcagagctctgcagcaacatttgtgtgtggtgcagctgacgaggttacttggcttgtaccacaccatggataaaaatcagaaattgagtgtggtcagagaattgatgttaaggtaccagcatggactggaatttgggaaaacctgtttgaaaacagaattgcaattttctgactattactgtctccttgctgtccatgcgcttattgatgtatggagggaaacaggtgatgagaccactgtgtggcaggccctgactttgctggaagagggattaacccatagcccttccaatgctcagttcaaattgctgcttgttcgaatctactgtatgctgggtgcatttgaaccagtggtggatctttactccagcctcgatgctaagcatatccagcatgataccattggttatcttttgacccgatatgctgaatctctaggtcagtatgctgctgcgtcccaatcctgtaacttcgcactcaggttttttcactccaaccagaaagatacctcagaatatattattcaagcttacaaatatggtgcatttgagaagatcccagagtttatcgcttttaggaacaggctgaataattctcttcattttgcacaagtccgtactgaacggatgctgttagaccttctacttgaagcaaatatatcaaccagtttagcagaaagtataaagtcaatgaaccttaggccagaagaagatgacattccatgggaagatttgcgagacaacagagacttaaatgtttttttcagctgggatccaaaagacagggacgtttctgaagaacataagaaactttccttagaggaggagaccttgtggttaagaatccgatccttaacattgaggctgataagtggacttccaagtctcaaccaccctgtggagccaaagaactcggagaagactgccgagaatggggtatcctcccggattgatattcttcgtttgctccttcaacagctggaggcaaccctggagacaggaaagcgatttattgagaaggatattcagtatcctttccttggtcctgtacctaccagaatgggtggattctttaattctggctgttctcagtgccagataagctctttttatcttgtcaatgatatttatgagctggataccagtggtttagaggatacaatggagattcaggaacgaatagaaaatagttttaagtctttactagaccagttaaaagatgtcttcagtaaatgtaaaggtgacctcttagaagttaaagatggtaacttgaaaacacatcctactcttttagaaaatctagttttctttgttgagactatttctgttatcctttgggtatccagttactgtgagagtgtcctacgaccatacaaactaaatttacagaaaaagaaaaagaagaaaaaagaaaccagcatcatcatgccacctgtctttaccagtttccaagactatgttactgggcttcagactttaatttccaatgttgtggatcatattaaagggcttgaaacacatctaattgcacttaaacttgaagaacttattttagaagacacttctctctcaccggaagagagaaaattttcaaagactgtgcaagggaaggtgcagagcagttatctgcactcacttctggaaatgggggagctgctgaaaaaaagacttgagaccacaaagaaactaaaaatttaaggaagtatctatcatgggcactgatgactctgcaacagaatatgacaccatcttcccaggcaaaagcaacatctggttgaccatgattttaatccagaacttcctcataaaatgcatgaaggactttgatcgtgaatttttttaggtgttaaatatatacaactgattaaattattgtatataaaccagaagcgggaccctcatctgggtttgaccactttttatacatgttcatatgcatatggcagcaacaagagaaccctacttttcttcttcccatcaccagaaacatcttttcaggggagcggggggtctataaaaacagcaatagaaattaagcataaagcatcaacctcatagcaactgaatagcccttccattataaataacattgagagtttttggtctggtccttgagccacaagaagtggaggggagaccatgcctgggaacagacccccttttcacagcagtaagtttgttttgaggctttctcagctacttggctcccacagaacccaaggcaggtacacaaaggaccttagatgagatctggcatatgcacccgcaatagaagggcaccacttggatgaccacaggcacttagtttttggctagtttttgtctgatagttaagacatccccatcctagcttctgtgagagttaaaaatctcaggtaagaaggcaaggaaggctctgttaatttatagctgtttagaggggaaagcagtgcagaccacttattaagcccgctgaggactagctttctgtctttcatacatttgggaaagataggaatgactgtttcaaagaagagaggtgcacataatttatgcaggcaagtatgatacttatttcattggttttgtgagtcatatatatacatatatatatatacacatatatatatgacttgaaaattaagatttaatactttaatgttttaagtgtggggggtttgggaaggaaggaatgtaatattatggatttagccttaggctttaagttttaggctggcaaaagaaatgttattcagtgggtttgaggtttggactactttcttcaaacttagagaattataacaggatggtgtttactttgttcacctggatgtccccaagactctagcttcttctatcagtggttggtctgatagaagaggtaaaaattgctcttgaaaatgtcctacaatttatgcagtttctttgataatatttttctgtttaaatccctgcttctgtttttggtctgttacctaaatatagttcaagtttaattctgtaagagcaaagaaatgaatttgatgaggaaattaagcatccaatggaggattggtcttgaagaccttaaaggtgctttccaacctgcactgctccagtgaaatgtggtacttttttcttttaaaagcaaccaagagagctgggaatatctgtgtacgcaaagtaattgcattttgtcccttcattttgactttcttagattcataatttgatacagtgcttaaacttccaaggaaattttaaacaattactacattacctgttcaaaataaggcttgttggaaatcctagtccatcaactaatttcaaaaatttatttttgatatgagtagcaacagctggtcatataccctatcccaaaaggaagaactgtcttgaacaagatgaatggaaaattgtggttaattctgaatttcatgtaatgacaacatattctttcataaaactatggcctgtttaagatggaactttgtgtgtgtctgctggggagggtggggtacatgtgtatggcgtgtgttcttgaaatgatgtctctctgaatatccaaaaaagtactgtactgtagaaatgctctttgaaaaagtctatcgactgaccatgatcaatctagcatatgtatgttcagtgggctagccttggtcctcagggacagtgtgtgactctagtggtcttcctaaccagtctcttgcctaaagatatctgggacctctactggctttaatgacaaataatgttatgttgaggttatgcttcctttgttatttgctgattttcctactaaatgtagcatttcaattagatccagctttcacattttgagataattgtaaaaagaatgaaattatgcagaaatggccaatatctcttatcaatctgttcttttggaaaccctcatgtactataaattgtgtacagttaaaaaaatatatatatatatatattcttacatgagtaaaaagcaccctctcccagcaatcgtatgccattggtatttgaagagaattcccaaataacccattgctgctgctgctgtttttgatttgtatgggtttttttgttttgtttgtttttgtgtggtaaactgatatttaaaaaaggaaaggagaaaaatcacgactactgtttacagactgaaaaattattgctttttatactactgagatcctaagttaagactctccaaagcaaacatttggtttaaatcatttatctgatgtagataaaaggtagagaaacttgtagtgttctccacataatggaaaatgtacaaatgcctagttgtgttgcccatcaattttgtatattttcataattttaattgttgaaaattgcattatattttgcaatcactatgttcaatctggatttgtctttcattttaacttttaatataaaaaggggtttcaatgta

SEQ ID NO: 71884 - DNA, 3637 bp, Homo sapiens
taagtgaatgagtaataagcggacatatatgtacatgcacacactgtagtataggagaagacatataaacagctaatttgatacagtgcaggatatgtactgatcaactgggtagattttgccatacatatgtaagttaagatttgcaggtaaggtggtatcttacctgcttggagagatgtgacgggagaggcatattgtaaagaacctttggattccatgcctaggaatttggactcttctctgagtgaaaaggatgttaaatcagtccccacttcttcagggaagtgacagaaaattggagtgaagtggaggatggattttgagctaggagagccagaagaaatgctgaagagttaggccattgtagtattctgagcaggagatgatgaaggcctggatcagtagagtgattgcagaaagtagagtggagattcacatgagaaattgaagggatttacatagaagaactgcgttagaatttgttgaatccattgcctctaatttcctgatagatatttttagtgtaatccttattggtgaatttgcaatttttcctttcagactatttctgttatcctttgggtatccagttactgtgagagtgtcctacgaccatacaaactaaatttacagaaaaagaaaaagaagaaaaaagaaaccagcatcatcatgccacctgtctttaccagtttccaagactatgttactgggcttcagactttaatttccaatgttgtggatcatattaaagggcttgaaacacatctaattgcacttaaacttgaagaacttattttagaagacacttctctctcaccggaagagagaaaattttcaaagactgtgcaagggaaggtgcagagcagttatctgcactcacttctggaaatgggggagctgctgaaaaaaagacttgagaccacaaagaaactaaaaatttaaggaagtatctatcatgggcactgatgactctgcaacagaatatgacaccatcttcccaggcaaaagcaacatctggttgaccatgattttaatccagaacttcctcataaaatgcatgaaggactttgatcgtgaatttttttaggtgttaaatatatacaactgattaaattattgtatataaaccagaagcgggaccctcatctgggtttgaccactttttatacatgttcatatgcatatggcagcaacaagagaaccctacttttcttcttcccatcaccagaaacatcttttcaggggagcggggggtctataaaaacagcaatagaaattaagcataaagcatcaacctcatagcaactgaatagcccttccattataaataacattgagagtttttggtctggtccttgagccacaagaagtggaggggagaccatgcctgggaacagacccccttttcacagcagtaagtttgttttgaggctttctcagctacttggctcccacagaacccaaggcaggtacacaaaggaccttagatgagatctggcatatgcacccgcaatagaagggcaccacttggatgaccacaggcacttagtttttggctagtttttgtctgatagttaagacatccccatcctagcttctgtgagagttaaaaatctcaggtaagaaggcaaggaaggctctgttaatttatagctgtttagaggggaaagcagtgcagaccacttattaagcccgctgaggactagctttctgtctttcatacatttgggaaagataggaatgactgtttcaaagaagagaggtgcacataatttatgcaggcaagtatgatacttatttcattggttttgtgagtcatatatatacatatatatatatacacatatatatatgacttgaaaattaagatttaatactttaatgttttaagtgtggggggtttgggaaggaaggaatgtaatattatggatttagccttaggctttaagttttaggctggcaaaagaaatgttattcagtgggtttgaggtttggactactttcttcaaacttagagaattataacaggatggtgtttactttgttcacctggatgtccccaagactctagcttcttctatcagtggttggtctgatagaagaggtaaaaattgctcttgaaaatgtcctacaatttatgcagtttctttgataatatttttctgtttaaatccctgcttctgtttttggtctgttacctaaatatagttcaagtttaattctgtaagagcaaagaaatgaatttgatgaggaaattaagcatccaatggaggattggtcttgaagaccttaaaggtgctttccaacctgcactgctccagtgaaatgtggtacttttttcttttaaaagcaaccaagagagctgggaatatctgtgtacgcaaagtaattgcattttgtcccttcattttgactttcttagattcataatttgatacagtgcttaaacttccaaggaaattttaaacaattactacattacctgttcaaaataaggcttgttggaaatcctagtccatcaactaatttcaaaaatttatttttgatatgagtagcaacagctggtcatataccctatcccaaaaggaagaactgtcttgaacaagatgaatggaaaattgtggttaattctgaatttcatgtaatgacaacatattctttcataaaactatggcctgtttaagatggaactttgtgtgtgtctgctggggagggtggggtacatgtgtatggcgtgtgttcttgaaatgatgtctctctgaatatccaaaaaagtactgtactgtagaaatgctctttgaaaaagtctatcgactgaccatgatcaatctagcatatgtatgttcagtgggctagccttggtcctcagggacagtgtgtgactctagtggtcttcctaaccagtctcttgcctaaagatatctgggacctctactggctttaatgacaaataatgttatgttgaggttatgcttcctttgttatttgctgattttcctactaaatgtagcatttcaattagatccagctttcacattttgagataattgtaaaaagaatgaaattatgcagaaatggccaatatctcttatcaatctgttcttttggaaaccctcatgtactataaattgtgtacagttaaaaaaatatatatatatatatattcttacatgagtaaaaagcaccctctcccagcaatcgtatgccattggtatttgaagagaattcccaaataacccattgctgctgctgctgtttttgatttgtatgggtttttttgttttgtttgtttttgtgtggtaaactgatatttaaaaaaggaaaggagaaaaatcacgactactgtttacagactgaaaaattattgctttttatactactgagatcctaagttaagactctccaaagcaaacatttggtttaaatcatttatctgatgtagataaaaggtagagaaacttgtagtgttctccacataatggaaaatgtacaaatgcctagttgtgttgcccatcaattttgtatattttcataattttaattgttgaaaattgcattatattttgcaatcactatgttcaatctggatttgtctttcattttaacttttaatataaaaaggggtttcaatgta

SEQ ID NO: 71885 - DNA, 3355 bp, Homo sapiens
atggctttttaaagaacttacaatggatagtctatcctttggagtttggttcattatggaaaatgaaaaacaaatagctttctaaattaaatttttatttgcttattctttatttgtgtgttgtgttccttaaaatagcattgaaacaaaagctgaataaaactaaaatgttttttgttttcagatgtcttcagtaaatgtaaaggtgacctcttagaagttaaagatggtaacttgaaaacacatcctactcttttagaaaatctagttttctttgttgagactatttctgttatcctttgggtatccagttactgtgagagtgtcctacgaccatacaaactaaatttacagaaaaagaaaaagaagaaaaaagaaaccagcatcatcatgccacctgtctttaccagtttccaagactatgttactgggcttcagactttaatttccaatgttgtggatcatattaaagggcttgaaacacatctaattgcacttaaacttgaagaacttattttagaagacacttctctctcaccggaagagagaaaattttcaaagactgtgcaagggaaggtgcagagcagttatctgcactcacttctggaaatgggggagctgctgaaaaaaagacttgagaccacaaagaaactaaaaatttaaggaagtatctatcatgggcactgatgactctgcaacagaatatgacaccatcttcccaggcaaaagcaacatctggttgaccatgattttaatccagaacttcctcataaaatgcatgaaggactttgatcgtgaatttttttaggtgttaaatatatacaactgattaaattattgtatataaaccagaagcgggaccctcatctgggtttgaccactttttatacatgttcatatgcatatggcagcaacaagagaaccctacttttcttcttcccatcaccagaaacatcttttcaggggagcggggggtctataaaaacagcaatagaaattaagcataaagcatcaacctcatagcaactgaatagcccttccattataaataacattgagagtttttggtctggtccttgagccacaagaagtggaggggagaccatgcctgggaacagacccccttttcacagcagtaagtttgttttgaggctttctcagctacttggctcccacagaacccaaggcaggtacacaaaggaccttagatgagatctggcatatgcacccgcaatagaagggcaccacttggatgaccacaggcacttagtttttggctagtttttgtctgatagttaagacatccccatcctagcttctgtgagagttaaaaatctcaggtaagaaggcaaggaaggctctgttaatttatagctgtttagaggggaaagcagtgcagaccacttattaagcccgctgaggactagctttctgtctttcatacatttgggaaagataggaatgactgtttcaaagaagagaggtgcacataatttatgcaggcaagtatgatacttatttcattggttttgtgagtcatatatatacatatatatatatacacatatatatatgacttgaaaattaagatttaatactttaatgttttaagtgtggggggtttgggaaggaaggaatgtaatattatggatttagccttaggctttaagttttaggctggcaaaagaaatgttattcagtgggtttgaggtttggactactttcttcaaacttagagaattataacaggatggtgtttactttgttcacctggatgtccccaagactctagcttcttctatcagtggttggtctgatagaagaggtaaaaattgctcttgaaaatgtcctacaatttatgcagtttctttgataatatttttctgtttaaatccctgcttctgtttttggtctgttacctaaatatagttcaagtttaattctgtaagagcaaagaaatgaatttgatgaggaaattaagcatccaatggaggattggtcttgaagaccttaaaggtgctttccaacctgcactgctccagtgaaatgtggtacttttttcttttaaaagcaaccaagagagctgggaatatctgtgtacgcaaagtaattgcattttgtcccttcattttgactttcttagattcataatttgatacagtgcttaaacttccaaggaaattttaaacaattactacattacctgttcaaaataaggcttgttggaaatcctagtccatcaactaatttcaaaaatttatttttgatatgagtagcaacagctggtcatataccctatcccaaaaggaagaactgtcttgaacaagatgaatggaaaattgtggttaattctgaatttcatgtaatgacaacatattctttcataaaactatggcctgtttaagatggaactttgtgtgtgtctgctggggagggtggggtacatgtgtatggcgtgtgttcttgaaatgatgtctctctgaatatccaaaaaagtactgtactgtagaaatgctctttgaaaaagtctatcgactgaccatgatcaatctagcatatgtatgttcagtgggctagccttggtcctcagggacagtgtgtgactctagtggtcttcctaaccagtctcttgcctaaagatatctgggacctctactggctttaatgacaaataatgttatgttgaggttatgcttcctttgttatttgctgattttcctactaaatgtagcatttcaattagatccagctttcacattttgagataattgtaaaaagaatgaaattatgcagaaatggccaatatctcttatcaatctgttcttttggaaaccctcatgtactataaattgtgtacagttaaaaaaatatatatatatatatattcttacatgagtaaaaagcaccctctcccagcaatcgtatgccattggtatttgaagagaattcccaaataacccattgctgctgctgctgtttttgatttgtatgggtttttttgttttgtttgtttttgtgtggtaaactgatatttaaaaaaggaaaggagaaaaatcacgactactgtttacagactgaaaaattattgctttttatactactgagatcctaagttaagactctccaaagcaaacatttggtttaaatcatttatctgatgtagataaaaggtagagaaacttgtagtgttctccacataatggaaaatgtacaaatgcctagttgtgttgcccatcaattttgtatattttcataattttaattgttgaaaattgcattatattttgcaatcactatgttcaatctggatttgtctttcattttaacttttaatataaaaaggggtttcaatgta

SEQ ID NO: 71886 - DNA, 3086 bp, Homo sapiens
actgtggttctgcgcttgtcatcatggcgacgcggggccatgtgcaggaccctaacgacaggcgcctccggcccatttacgattatcttgacaatggtaataataaaatggcaattcagcaagcagataaactgttgaagaaacataaggatcttcattgtgctaaggttttaaaggcaattggtttacagagaactggaaagcaagaggaagcctttactcttgcacaggaggtggcagcccttgaacccacagatgacaactcactgcaggcactgactatcctttaccgggagatgcaccgaccggagttagttacaaaactttatgaggcagctgtgaagaaagttcccaatagtgaggagtatcactctcacctcttcatggcctatgccagagtgggtgaatacaagaaaatgcaacaggctggcatggctctatataagattgtccccaaaaatccctactacttttggtctgtgatgagcttaattatgcaatctatatcggcacaggatgaaaacctctcaaaaacaatgtttctgccccttgctgagagaatggtcgaaaaaatggtgaaagaggacaagatagaagctgaggctgaagttgaactttattatatgatcctggaacgtttgggaaagtaccaggaggccttggatgtcatcagagggaaattaggagagaagttgacaagtgagattcagagtcgggaaaataaatgcatggctatgtacaagaagctgagcaggtggccagagtgcaatgccctttcccggcgcctcttactaaaaaactcagatgactggcagttctatctgacttatttcgattctgtctttcgactgattgaagaggcctggagtcctcctgctgaaggtgaacactctttagaaggagaagtacattattctgcagaaaaagctgtgaagtttatagaagatcggataacggaagaatctaaaagttctcgccatctccgaggaccacatctagctaaattggagctgattaggcgtttacgaagtcaaggttgtaacgatgagtacaaactgggtgatccagaagaattaatgttccagtattttaaaaagtttggcgataaaccttgttgttttacagaccttaaggtgtttgttgacctcttacctgctacacagtgtacaaaatttattaatcagttacttggagttgttcctttgtcgacaccaacagaggataagctggcactgcctgctgacatcagagctctgcagcaacatttgtgtgtggtgcagctgacgaggttacttggcttgtaccacaccatggataaaaatcagaaattgagtgtggtcagagaattgatgttaaggtaccagcatggactggaatttgggaaaacctgtttgaaaacagaattgcaattttctgactattactgtctccttgctgtccatgcgcttattgatgtatggagggaaacaggtgatgagaccactgtgtggcaggccctgactttgctggaagagggattaacccatagcccttccaatgctcagttcaaattgctgcttgttcgaatctactgtatgctgggtgcatttgaaccagtggtggatctttactccagcctcgatgctaagcatatccagcatgataccattggttatcttttgacccgatatgctgaatctctaggtcagtatgctgctgcgtcccaatcctgtaacttcgcactcaggttttttcactccaaccagaaagatacctcagaatatattattcaagcttacaaatatggtgcatttgagaagatcccagagtttatcgcttttaggaacaggctgaataattctcttcattttgcacaagtccgtactgaacggatgctgttagaccttctacttgaagcaaatatatcaaccagtttagcagaaagtataaagtcaatgaaccttaggccagaagaagatgacattccatgggaagatttgcgagacaacagagacttaaatgtttttttcagctgggatccaaaagacagggacgtttctgaagaacataagaaactttccttagaggaggagaccttgtggttaagaatccgatccttaacattgaggctgataagtggacttccaagtctcaaccaccctgtggagccaaagaactcggagaagactgccgagaatggggtatcctcccggattgatattcttcgtttgctccttcaacagctggaggcaaccctggagacaggaaagcgatttattgagaaggatattcagtatcctttccttggtcctgtacctaccagaatgggtggattctttaattctggctgttctcagtgccagataagctctttttatcttgtcaatgatatttatgagctggataccagtggtttagaggatacaatggagattcaggaacgaatagaaaatagttttaagtctttactagaccagttaaaagatgtcttcagtaaatgtaaaggtgacctcttagaagttaaagatggtaacttgaaaacacatcctactcttttagaaaatctagttttctttgttgaggtaagtttttgttctcttcctaaaagacattgttgttcttaatggtctacaggattcatttttcaacagtgaacaggtaataggcaccttatacctgtaacttaaccctccatccctgtttttgttaattgaaaagcaatttaaatcattttctaaaccaatttcttccaagaattctaagatgatttcattcataatacttaggtaaaacttcttgaaatttgctgtactcatctctaaacttccccagattcacctcaaatctagctgttttcattctcctttctgactcactctttattatgtagtttaattcctccagcttcttttatttgttgtcatttattaattgctaagatattatgcattgtgatagtgtccagcaactgatacagcaaaactccctcctctttttttgccagagggaagagaaggaagattgcaaacactcataatctattatcttttcttttatttctgtcacatatttgttgactgttctccccttactactctgtgtgggga

SEQ ID NO: 71887 - DNA, 2260 bp, Homo sapiens
actgtggttctgcgcttgtcatcatggcgacgcggggccatgtgcaggaccctaacgacaggcgcctccggcccatttacgattatcttgacaatggtaataataaaatggcaattcagcaagcagataaactgttgaagaaacataaggatcttcattgtgctaaggttttaaaggcaattggtttacagagaactggaaagcaagaggaagcctttactcttgcacaggaggtggcagcccttgaacccacagatgacaactcactgcaggcactgactatcctttaccgggagatgcaccgaccggagttagttacaaaactttatgaggcagctgtgaagaaagttcccaatagtgaggagtatcactctcacctcttcatggcctatgccagagtgggtgaatacaagaaaatgcaacaggctggcatggctctatataagattgtccccaaaaatccctactacttttggtctgtgatgagcttaattatgcaatctatatcggcacaggatgaaaacctctcaaaaacaatgtttctgccccttgctgagagaatggtcgaaaaaatggtgaaagaggacaagatagaagctgaggctgaagttgaactttattatatgatcctggaacgtttgggaaagtaccaggaggccttggatgtcatcagagggaaattaggagagaagttgacaagtgagattcagagtcgggaaaataaatgcatggctatgtacaagaagctgagcaggtggccagagtgcaatgccctttcccggcgcctcttactaaaaaactcagatgactggcagttctatctgacttatttcgattctgtctttcgactgattgaagaggcctggagtcctcctgctgaaggtgaacactctttagaaggagaagtacattattctgcagaaaaagctgtgaagtttatagaagatcggataacggaagaatctaaaagttctcgccatctccgaggaccacatctagctaaattggagctgattaggcgtttacgaagtcaaggttgtaacgatgagtacaaactgggtgatccagaagaattaatgttccagtattttaaaaagtttggcgataaaccttgttgttttacagaccttaaggtgtttgttgacctcttacctgctacacagtgtacaaaatttattaatcagttacttggagttgttcctttgtcgacaccaacagaggataagctggcactgcctgctgacatcagagctctgcagcaacatttgtgtgtggtgcagctgacgaggttacttggcttgtaccacaccatggataaaaatcagaaattgagtgtggtcagagaattgatgttaaggtaccagcatggactggaatttgggaaaacctgtttgaaaacagaattgcaattttctgactattactgtctccttgctgtccatgcgcttattgatgtatggagggaaacaggtgatgagaccactgtgtggcaggccctgactttgctggaagagggattaacccatagcccttccaatgctcagttcaaattgctgcttgttcgaatctactgtatgctgggtgcatttgaaccagtggtggatctttactccagcctcgatgctaagcatatccagcatgataccattggttatcttttgacccgatatgctgaatctctaggtcagtatgctgctgcgtcccaatcctgtaacttcgcactcaggttttttcactccaaccagaaagatgtaagtgaaaaactattttttaactgtgatcttgtctgctgactgcacactattgaggagcacgtcaccacatgtcacaagtacacatgttaaggtgcaccatgctgaactagcaagtgcccttagaccaaagcttactgtccaaggctggtagggagaggtagagagttatttgtgtttgttagaatgggcgtgtttaatagaatccttggaaagttgcatttaaaaactggtatttactgactaggaagtgttagtcctcttagacctggcttttaatctctaagagacttttccaagggtataagaaacagtccataagcgttcatagcctgggatgccgtgtaacatcctgcaatagcagctgctctctgttacttttatttaactctgaaatgtatgtccattgtgctctttgccaaaggtgaatgtacttgtattttcttagaaaattaaaaggcattccgagaaacctaggtgaataatatgttttttaaagtagcaataaa

SEQ ID NO: 71888 - DNA, 172 bp, Homo sapiens
acgaccatacaaactaaatttacagaaaaagaaaaagaagaaaaaagaaaccagcatcatcatggtaataacagtaacacaagtgatatacaaggaacaatctgaccacatgctactttttcttttcactgttttcctccatgttgagtccttaggatcctatatgccaagc

SEQ ID NO: 71889 - DNA, 389 bp, Homo sapiens
aaagattttttaattaacttggacaaaagtatgaaatttctactatgctcaatttgcttccaataaatggaattaaagggggcagataacaatattccttaagtgttctggattttatttactcattgtaatgtaaacagagactcatatcccactaatttgggggctttgtttctataactcaccttctaatgacaatggctgggcaaatgaatactaccttgctccaccccaatttggtccttgtcagcatcaatcccagtgaattttcactttctttcctttccaaatcaaggctttgctctataataacccattcagaaaagtgattactgaagttttggtaacagctttcaaaaaaataccctacagcaatttggaataatctg

SEQ ID NO: 71890 - DNA, 572 bp, Homo sapiens
ctttcttattgttacaagatttcaaaggagggcttctcctcaaattctacactgcggagctcccttcccactccacagaagctccgacagcatccacagttgtccatgtgcagcacaacaaatcaagccaggcagatctcccattggcactagttaccaacttcctagagaaacccatcaatctcaaaattcctgctctagcaagtcctggaaaagagactagagcccaaatgccttcactctgccaagggagcttccctttttgtgtgtctgtgccatggacttcttgaagtagggaagcctgtggaccccttctcactgtgatgttttttaaatgcataaaatagaacatggagtatttcaaagaaaaccaattacattgaaatacaatgaccaaatattttaaaaatgaatttgtgttatagtaatatatgtttctataataatgctttaaataacaatagcagcagatctaaacaattgaaatgtctaaatggtgagcgtaagtcacatgctgagacgtctgcaacaacaaactcataggtacagctgatactaggaaatattaattt

SEQ ID NO: 71891 - DNA, 324 bp, Homo sapiens
cccagtccaagcagtacctttatattcattgggatttgggctagctgttgaaacaaaggctaggataataaaatagattatttttatctatgcaggcagcctctgtgcaagctgtccagtacatgcacggaggcctcattgtgctggggacccagacaccttctttctcattgctctgttaccctcgtacagggtttctgcctcgtggtctgaggaggctgctcttgctcccactgtcgtatctatattccagccaccgggaagggaggagggcatgatctgaaattagcagacctcactctgctcgtgtcatatgtttataac

SEQ ID NO: 71892 - DNA, 410 bp, Homo sapiens
tataacattaccttcaggctatgtgtaaaaagtgtatataaaatgtaaatgaatttcatggttagactggagtcccatccccaagatatctctttatggatatgcaaatattctaaaatccaaaaaatcgaaaacactttcagtctcaagcatttcagataagagatacttaacctgtatatcgcttaagaaaatgtttcctgaggaaaccatcacacgaagggatacatctctgttagccaatgcagccataaataaaaatgttaatgaggtaaaattggtcatgatgaaggtaaaacaatatcaagaaactgaaaaagttcttgttaagcttaattcattttgacatattttgaaaaaagtctcagatgcattgtagcaaatcttaattaaaccagaaatccattata

SEQ ID NO: 71893 - DNA, 262 bp, Homo sapiens
gtagagatggagttccgccatattccccaggctgataggctggtcttgaactcctgggcttaagtgatctgcccccctcagcctctcaaaatgctgacattataggcgtgagccactatgcttcgccagatcttcttgtttttgtttttgctaaatcttttgttgttgttgttgttgttgttttgagatggactctcgctctgtcgcccaggctggagtgcagtggcgccatctcagctcactgcaacctccacctcccagg

SEQ ID NO: 71894 - DNA, 753 bp, Homo sapiens
atcagaaaacaattagcaaaataacaagaatagatctttacttaacaacattgaatgtatatggtttaagttcccattaaaacttagacactggctgaatggatgtaaaaaaagaagaccgaattctatgctacctacaagaaactcaacttcacctgtaaaaagcacaatagactaaatgtaaagggaaggaaaaatcccatgtaaatggaaaccaagagcgtacagaagcagttattttagacaaaatatactttgtaaaaaaccataaaaagagacaaggtcaatatcaaatgataaagggatcaattcagcgaaaggatataacaattgtaaatatgtacctaatactggagcacccagatatatgaagtaaatattgttaaagatagagaaacagactccaatacaatagtagttggggacttcagcacaccagattcaccactggacagatcatctagacagaaaacaaacattggacttaatctgcacggtagaccaaaggaacctaataaacatttaaacaacattttatccaacagctgcagaatatgcattcttcacctcagcacgtgaaacactcttcagaaaagaccatatgttaggccacaaaacaagtctcaaaaaaatttttaaatagtaattatatccagtattttctcacaccacaattgaataaaactagaaatcaataacaaggaactttggaaactgtacaaatacatggaaattaaacaacactctcctgaa

SEQ ID NO: 71895 - DNA, 915 bp, Homo sapiens
ccaggtataggtcttgctcttataccttatcctggctacctgccagtactccagcttccccacagctgaggtcttctttgcattcggccaaacccttttctgactccaggccccaagggtgcgagcctatcacctgatatgaacttcctccctcctctagtctgcctgaatcctccattaccaccttcatcccaccctattccaccttgcccctgtctgctgagccatctgcatttgctgaacctcgctaaggcatagtctgccaacattgtctgctgggggtacagagagagcctccctctccctgtgtctcgagttcagcacctattccaccttagtaagcctgtgaggctttccaggcatctctcccaagctggtctgtcccttgtcttcagggctcctgttctgacactgggcccatgggaggtacaagttttgagtcctgtaaaaagaaaaaagaaggaagtgtccttcacacaacttctgacctttttcttcacttcctggtgtgttagtgtgtaagagagagagagagtgtgtgtgtgtgtgtgtgtgtgtgatgtttagggtctgaggatattcaaagtggaaaagggtataagagctaggtaatttttattttgtgactaggcaaaggcagtctaaaaaactgacctatggagacaattttagttctcttctacctgttaatgtaagagatgtaaaaactaaagtctttcttttcaaagtgactactagaaaatccttttggactgtaggtaatacagaatgtttataatcagaccaacaaaatactattcctacacattgttttctatgacctagaaataaggatgttacagatccttctttgtaatggaatttgttgtcctaagatcatacccattgtaaaatttaggacttttcgttggtaaa

SEQ ID NO: 71896 - DNA, 127 bp, Homo sapiens
attctacccaggaactgtggcccttatgtccatgcattgcagctttaagaaaggataataaacaatccagatagaccagacgcatcctgctccaaggattatttagatgagaaatcagtttgcgtga

SEQ ID NO: 71897 - DNA, 432 bp, Homo sapiens
aggatggccattagggatcagggatgctaatgaaacatcaacaatgttaccttgtaaaattttgaacaaatactactattagataaaacttttaatttgaaactaaaagaagtgaagcgtatgtctgtgttttagatttgccttttttgaacaaaaggttcattcagtcaaacatgaagtcaacacactcaggaaagtgtcaggatttccagattgtgggtctttcttctgattcgagttgcatcagccacggttctaaggagaattctactcccaagatcagcattctagtggaatcataaaaggtcccacaccaccatcagtgaacttaggatctccatggggatgtttacccaaaactcaaactgaaaaatgtaaccttccagccaggcacggtggcttacacctgtaatcccagcactttgagaagcc

SEQ ID NO: 71898 - DNA, 745 bp, Homo sapiens
gctcctggttcactgcagattatcaatcagtggaaagtgatagaagcaatggatcagcagaatgggtatagaggcaatgttcagtctttgtatggtggaaagtggagctgatgaggttaatttgcacggtgtgaccagccttggcttaaagcaggctctggagtttgcatacacaggacaggccatgcctcttctgcaagactatacaacatccttgctcctctgatgggagctgcactaatttcgtgaatgtcagtcaaagcctccttccttgaggagttggcgaaagacgggtttctctttctgactagatggaaaaggagatataaagatttttcagaataagatgagtattttgctggagccaggtgtgatccaggatgtgctagcagcgggcagtcacctacagctgttggagcttctcaatttatgctcccactatctcatccaggaattaaatagctttaattacttggatctgtacagacttgctgacctctttaacctcactttgttggagaaggcagtgatcgatttcttagtgaaacatctctctgaactcctgaagagccgcccagaagaagttctaacgcttccctattgcctgcttcaggaggtgctgaagagcgaccgcctgacctccctgagtgaagagcagatctggcaggtggagtaactaatacggcacaatatcagaacaggctaatggtgtatgaacctaaccaggtaagaatcatgtaagaac

SEQ ID NO: 71899 - DNA, 3684 bp, Homo sapiens
gtttccccgcgcgacagttcgggagcgcgcaggcagtcgcgcgcacacacgcacgcaggcacacacacacacacacacacacacacacacacactttcgcacacacaaacacgctaggacgctcgtcttcgctactgcatccccgaaccagcagagcgaagctactgcgggttctgttaacctcagcatcgtggggcgaagcagagccattgtgcatcaaggagaggccggtgcctgcgctgccgtctctggcacctaacccagcagaccgctcaccccatcggctggaatgcttgctgattcctctgcacacttctaaggctgagaacctgaggaacccagctggaaaatgccgtctgaacgctgcctcagtattcaagaaatgctgacaggccagaggctctgccactccgaatctcacaatgacagtgtcctggcagcgctgaatcagcagaggagtgatggcatcctctgcgacatcaccctgattgctgaggaacagaaattccatgctcacaaggcagtcctagcagcatgcagtgactatttccgggcaatgttcagtctttgtatggtggaaagtggagctgatgaggttaatttgcacggtgtgaccagccttggcttaaagcaggctctggagtttgcatacacaggacagattttgctggagccaggtgtgatccaggatgtgctagcagcgggcagtcacctacagctgttggagcttctcaatttatgctcccactatctcatccaggaattaaatagctttaattacttggatctgtacagacttgctgacctctttaacctcactttgttggagaaggcagtgatcgatttcttagtgaaacatctctctgaactcctgaagagccgcccagaagaagttctaacgcttccctattgcctgcttcaggaggtgctgaagagcgaccgcctgacctccctgagtgaagagcagatctggcagctagctgtgaggtggttggaacacaactgccactaccagtacatggacgagctcctgcaatacatccgctttggcctaatggatgtggatactctccatacagttgccctgtcccacccccttgtccaagcaagtgagactgcaacagcccttgtcaacgaggccctggaataccaccagagcatctatgcacagcctgtctggcagactcgcaggaccaaaccacgattccagtcagacactctgtatatcattggtgggaaaaagcgcgaggtctgcaaggtcaaggaacttcggtacttcaatcctgttgatcaggagaatgctctcatagctgccattgccaactggagtgagctggctcccatgcctgtgggaaggagccaccattgtgtggcagtcatgggggacttcctgtttgtggcaggaggggaagttgagcatgccagtggccggacgtgtgctgtgaggactgcctgtcgctatgacccccgcagtaattcctgggcagagatagcacccatgaaaaactgccgggagcattttgtgctgggtgccatggaggaatacctctatgcagttgggggcagaaatgaactgcgccaggttctgcctacagttgagcgatattgccccaagaagaacaaatggacttttgttcagtcctttgacagatccctttcatgccatgctggatatgtggctgatggtcttctttggatatcaggtggagtaactaatacggcacaatatcagaacaggctaatggtgtatgaacctaaccagaataagtggataagccgtagccccatgctgcagagaagggtctaccattccatggctgctgtacaaaggaagctttatgttcttggaggcaatgacctagactacaataatgaccggatccttgtgcgccatatagattcttacaacatagacactgaccagtggacacgttgtaatttcaacctgctgactggccaaaatgaatctggagttgctgtccataatgggagaatatatttagttggtggatattcaatttggacaaatgagcctctggcttgtatccaggtactggatgtaagcagagaaggcaaagaagaagtattctatgggcctacactcccttttgcttccaatggaatagcagcatgcttccttccagctccatattttacatgccctaaccttcaaactcttcaagtgcctcatcacaggattggcaccatctgaaaagccaagccatcatgaacaggaggaaaacatagctctgactgttggatactgggcatgaaaagactcagtgctccatgcttccttgtcttgctttataggtcttatattcggataaatttaagcaaaaaatgaacaattttctaaaatacgttattgaaaactcgtcacccttctcagtgtatgtcaacattcaatatgtatgacttttattgtggtatagcttagtgccaatttaaggtatattgtgttccatgggtctttagagcattctttgtacactttttctaatcagcactgtcttaagacaacataacactgttagtaaggcaatttattggacacaatggcatcgatgatcttaaaaatatatatattctgtacttaatccctttattatttaaagccgggcttgtaatttttctttttaaaatttaacattatgcagccctgctcagtagagactcactcagcattatgacatcataaatttttaaatgccatattttattcaaggtgatacgaataataatagacatacactggaacagcagttgttgaaatacccagatttttcaccttggttactctgaccttgggtcagaacctaactttacagtgcttcagttttcccaccttttaaggaggataattactgatttccacgttaatttaaaagaacattatgaggattaggcgaacactttgtaatactttgcccaagaaaaagaaaaatgttgttactgaaattataaggtattttattgtctttagaaccttgtaattgaacagggagattatttttgaagtttaaaaattactagatagaatttggaaacatgttgtggaataaatgattctaaaaagcatgtgaaagagacacacaatgaggaaatagggagtttctcaaaatctaaacttgtacaggtatctaaacttgcctcaagtaactctcagatgtcttatttaaaatcatttagtgaaaaatgacatttaaagctaaaaaataatttagttgtactaattatggtaccataaagtgctttgacataaatttgaacctagaattggcagttctaataaaagtttttccactttgttaaaggttatgtcaatcttgagtgcttgtggaattcttcaccaccaatacatattttattactatctcttttaataatgcataggaattcttttttagactagtttttgggtttgctttgtctataacaaaaaataaatacaacaacttaataatcacatttgaaaacaaatttaacaagtataatgtgagtttttcttttttcctaacttcctcaggacctaggtcacctttattaaaaggaagaattcactcttttttccttggcagtttaatcattcaggaatccctctcttaaaggaaattgttattttattcatgtaacctttttttgtaatcaaaagtgaataaaaacgatctttttgtcttacag

SEQ ID NO: 71900 - DNA, 3763 bp, Homo sapiens
gtttccccgcgcgacagttcgggagcgcgcaggcagtcgcgcgcacacacgcacgcaggcacacacacacacacacacacacacacacacacactttcgcacacacaaacacgctaggacgctcgtcttcgctactgcatccccgaaccagcagagcgaagctactgcgggttctgttaacctcagcatcgtggggcgaagcagagccattgtgcatcaaggagaggccggtgcctgcgctgccgtctctggcacctaacccagcagaccgctcaccccatcggctggaatgcttgctgattcctctgcacacttctaaggctgagaacctgaggaacccagctggaaaatgccgtctgaacgctgcctcagtattcaagaaatgctgacaggccagaggctctgccactccgaatctcacaatgacagtgtcctggcagcgctgaatcagcagaggagtgatggcatcctctgcgacatcaccctgattgctgaggaacagaaattccatgctcacaaggcagtcctagcagcatgcagtgactatttccgggcaatgttcagtctttgtatggtggaaagtggagctgatgaggttaatttgcacggtgtgaccagccttggcttaaagcaggctctggagtttgcatacacaggacagattttgctggagccaggtgtgatccaggatgtgctagcagcgggcagtcacctacagctgttggagcttctcaatttatgctcccactatctcatccaggaattaaatagctttaattacttggatctgtacagacttgctgacctctttaacctcactttgttggagaaggcagtgatcgatttcttagtgaaacatctctctgaactcctgaagagccgcccagaagaagttctaacgcttccctattgcctgcttcaggaggtgctgaagagcgaccgcctgacctccctgagtgaagagcagatctggcagaagtgtggaatttgtgctgccttttgtgcactgaggggagactggtgccctggcttacctcaatgggatgacaagactgctagctgtgaggtggttggaacacaactgccactaccagtacatggacgagctcctgcaatacatccgctttggcctaatggatgtggatactctccatacagttgccctgtcccacccccttgtccaagcaagtgagactgcaacagcccttgtcaacgaggccctggaataccaccagagcatctatgcacagcctgtctggcagactcgcaggaccaaaccacgattccagtcagacactctgtatatcattggtgggaaaaagcgcgaggtctgcaaggtcaaggaacttcggtacttcaatcctgttgatcaggagaatgctctcatagctgccattgccaactggagtgagctggctcccatgcctgtgggaaggagccaccattgtgtggcagtcatgggggacttcctgtttgtggcaggaggggaagttgagcatgccagtggccggacgtgtgctgtgaggactgcctgtcgctatgacccccgcagtaattcctgggcagagatagcacccatgaaaaactgccgggagcattttgtgctgggtgccatggaggaatacctctatgcagttgggggcagaaatgaactgcgccaggttctgcctacagttgagcgatattgccccaagaagaacaaatggacttttgttcagtcctttgacagatccctttcatgccatgctggatatgtggctgatggtcttctttggatatcaggtggagtaactaatacggcacaatatcagaacaggctaatggtgtatgaacctaaccagaataagtggataagccgtagccccatgctgcagagaagggtctaccattccatggctgctgtacaaaggaagctttatgttcttggaggcaatgacctagactacaataatgaccggatccttgtgcgccatatagattcttacaacatagacactgaccagtggacacgttgtaatttcaacctgctgactggccaaaatgaatctggagttgctgtccataatgggagaatatatttagttggtggatattcaatttggacaaatgagcctctggcttgtatccaggtactggatgtaagcagagaaggcaaagaagaagtattctatgggcctacactcccttttgcttccaatggaatagcagcatgcttccttccagctccatattttacatgccctaaccttcaaactcttcaagtgcctcatcacaggattggcaccatctgaaaagccaagccatcatgaacaggaggaaaacatagctctgactgttggatactgggcatgaaaagactcagtgctccatgcttccttgtcttgctttataggtcttatattcggataaatttaagcaaaaaatgaacaattttctaaaatacgttattgaaaactcgtcacccttctcagtgtatgtcaacattcaatatgtatgacttttattgtggtatagcttagtgccaatttaaggtatattgtgttccatgggtctttagagcattctttgtacactttttctaatcagcactgtcttaagacaacataacactgttagtaaggcaatttattggacacaatggcatcgatgatcttaaaaatatatatattctgtacttaatccctttattatttaaagccgggcttgtaatttttctttttaaaatttaacattatgcagccctgctcagtagagactcactcagcattatgacatcataaatttttaaatgccatattttattcaaggtgatacgaataataatagacatacactggaacagcagttgttgaaatacccagatttttcaccttggttactctgaccttgggtcagaacctaactttacagtgcttcagttttcccaccttttaaggaggataattactgatttccacgttaatttaaaagaacattatgaggattaggcgaacactttgtaatactttgcccaagaaaaagaaaaatgttgttactgaaattataaggtattttattgtctttagaaccttgtaattgaacagggagattatttttgaagtttaaaaattactagatagaatttggaaacatgttgtggaataaatgattctaaaaagcatgtgaaagagacacacaatgaggaaatagggagtttctcaaaatctaaacttgtacaggtatctaaacttgcctcaagtaactctcagatgtcttatttaaaatcatttagtgaaaaatgacatttaaagctaaaaaataatttagttgtactaattatggtaccataaagtgctttgacataaatttgaacctagaattggcagttctaataaaagtttttccactttgttaaaggttatgtcaatcttgagtgcttgtggaattcttcaccaccaatacatattttattactatctcttttaataatgcataggaattcttttttagactagtttttgggtttgctttgtctataacaaaaaataaatacaacaacttaataatcacatttgaaaacaaatttaacaagtataatgtgagtttttcttttttcctaacttcctcaggacctaggtcacctttattaaaaggaagaattcactcttttttccttggcagtttaatcattcaggaatccctctcttaaaggaaattgttattttattcatgtaacctttttttgtaatcaaaagtgaataaaaacgatctttttgtcttacag

SEQ ID NO: 71901 - DNA, 2741 bp, Homo sapiens
gtttccccgcgcgacagttcgggagcgcgcaggcagtcgcgcgcacacacgcacgcaggcacacacacacacacacacacacacacacacacactttcgcacacacaaacacgctaggacgctcgtcttcgctactgcatccccgaaccagcagagcgaagctactgcgggttctgttaacctcagcatcgtggggcgaagcagagccattgtgcatcaaggagaggccggtgcctgcgctgccgtctctggcacctaacccagcagaccgctcaccccatcggctggaatgcttgctgattcctctgcacacttctaaggctgagaacctgaggaacccagctggaaaatgccgtctgaacgctgcctcagtattcaagaaatgctgacaggccagaggctctgccactccgaatctcacaatgacagtgtcctggcagcgctgaatcagcagaggagtgatggcatcctctgcgacatcaccctgattgctgaggaacagaaattccatgctcacaaggcagtcctagcagcatgcagtgactatttccgggcaatgttcagtctttgtatggtggaaagtggagctgatgaggttaatttgcacggtgtgaccagccttggcttaaagcaggctctggagtttgcatacacaggacagattttgctggagccaggtgtgatccaggatgtgctagcagcgggcagtcacctacagctgttggagcttctcaatttatgctcccactatctcatccaggtggagtaactaatacggcacaatatcagaacaggctaatggtgtatgaacctaaccagaataagtggataagccgtagccccatgctgcagagaagggtctaccattccatggctgctgtacaaaggaagctttatgttcttggaggcaatgacctagactacaataatgaccggatccttgtgcgccatatagattcttacaacatagacactgaccagtggacacgttgtaatttcaacctgctgactggccaaaatgaatctggagttgctgtccataatgggagaatatatttagttggtggatattcaatttggacaaatgagcctctggcttgtatccaggtactggatgtaagcagagaaggcaaagaagaagtattctatgggcctacactcccttttgcttccaatggaatagcagcatgcttccttccagctccatattttacatgccctaaccttcaaactcttcaagtgcctcatcacaggattggcaccatctgaaaagccaagccatcatgaacaggaggaaaacatagctctgactgttggatactgggcatgaaaagactcagtgctccatgcttccttgtcttgctttataggtcttatattcggataaatttaagcaaaaaatgaacaattttctaaaatacgttattgaaaactcgtcacccttctcagtgtatgtcaacattcaatatgtatgacttttattgtggtatagcttagtgccaatttaaggtatattgtgttccatgggtctttagagcattctttgtacactttttctaatcagcactgtcttaagacaacataacactgttagtaaggcaatttattggacacaatggcatcgatgatcttaaaaatatatatattctgtacttaatccctttattatttaaagccgggcttgtaatttttctttttaaaatttaacattatgcagccctgctcagtagagactcactcagcattatgacatcataaatttttaaatgccatattttattcaaggtgatacgaataataatagacatacactggaacagcagttgttgaaatacccagatttttcaccttggttactctgaccttgggtcagaacctaactttacagtgcttcagttttcccaccttttaaggaggataattactgatttccacgttaatttaaaagaacattatgaggattaggcgaacactttgtaatactttgcccaagaaaaagaaaaatgttgttactgaaattataaggtattttattgtctttagaaccttgtaattgaacagggagattatttttgaagtttaaaaattactagatagaatttggaaacatgttgtggaataaatgattctaaaaagcatgtgaaagagacacacaatgaggaaatagggagtttctcaaaatctaaacttgtacaggtatctaaacttgcctcaagtaactctcagatgtcttatttaaaatcatttagtgaaaaatgacatttaaagctaaaaaataatttagttgtactaattatggtaccataaagtgctttgacataaatttgaacctagaattggcagttctaataaaagtttttccactttgttaaaggttatgtcaatcttgagtgcttgtggaattcttcaccaccaatacatattttattactatctcttttaataatgcataggaattcttttttagactagtttttgggtttgctttgtctataacaaaaaataaatacaacaacttaataatcacatttgaaaacaaatttaacaagtataatgtgagtttttcttttttcctaacttcctcaggacctaggtcacctttattaaaaggaagaattcactcttttttccttggcagtttaatcattcaggaatccctctcttaaaggaaattgttattttattcatgtaacctttttttgtaatcaaaagtgaataaaaacgatctttttgtcttacag

SEQ ID NO: 71902 - DNA, 274 bp, Homo sapiens
tgcctacagttgagcgatattgccccaagaagaacaaatggacttttgttcagtcctttgacagatccctttcatgccatgctggatatgtggctgatggtcttctttggatatcaggtagaacatacctcatgttggatttatcaaaacacactttcattgtggtatatatttaaaagtcaagctttaatactgtggccatgtgtaattgaaagattgaaccaagcatgccattttagctaattaacattcatttattgagcacctactctag

SEQ ID NO: 71903 - DNA, 774 bp, Homo sapiens
ctgccatggacattcacgtataagtttttgtgtggatatatgttttcatttctttggagtagagttgctgggtcatggggtaaccctaggtttaagcttttgaggcctaccagatttccaaagtgactgcatcattttgcattcccatcaacagtatatgaaggttctaacttctctacatcttcaccaatatttgttattgtctgtcttcttgacaaaagttctcctagtgggtgtgaactggtatcattttgtggttttgatttgcatttcctggatggttatgaatgttgattttactttcatgtgcttattggccattgtatatctttgggaaaatagctattttcccaaacttttgcccagtttaaaattgagttttctttttattactgagttggaagtgttctttatatattctggatactagaccagcagcagatatatggcagatattttttcccattctgtgggttgcctttcactttcttggtggtgttctttgaagccccaaagtttttaattttgatgatatgcaatttatctatttttccttttgttgcatgtgcttttggtgtcatatctaagaaatcattgcataatggtttccaaggtaatctgggactattagaccatcaaaatagatgatagtaacagattatacattgaatggaataggaattcatgagcccataataataataaattgacaaaaagatacatagtgtggagctgaattggaaacctcttcctgacaataaaaggttgactgat

SEQ ID NO: 71904 - DNA, 477 bp, Homo sapiens
cgcggcccgcgaccggctgcgagaagacgacagagggtatatcgggaaatagctacccaactgccccagtttaaaattgagttttctttttattactgagttggaagtgttctttatatattctggatactagaccagcagcagatatatggcagatattttttcccattctgtgggttgcctttcactttcttggtggtgttctttgaagccccaaagtttttaattttgatgatatgcaatttatctatttttccttttgttgcatgtgcttttggtgtcatatctaagaaatcattgcataatggtttccaaggtaatctgggactattagaccatcaaaatagatgatagtaacagattatacattgaatggaataggaattcatgagcccataataataataaattgacaaaaagatacatagtgtggagctgaattggaaacctcttcctgacaataaaaggttgactgat

SEQ ID NO: 71905 - DNA, 4671 bp, Homo sapiens
  misc_feature (5)..(5): n is a, c, g, or t
  misc_feature (7)..(7): n is a, c, g, or t
  misc_feature (830)..(830): n is a, c, g, or t
  misc_feature (2103)..(2103): n is a, c, g, or t
  misc_feature (3076)..(3076): n is a, c, g, or t
  misc_feature (3197)..(3197): n is a, c, g, or t
  misc_feature (3832)..(3832): n is a, c, g, or t
  misc_feature (4313)..(4313): n is a, c, g, or t
acttntnccagcagctggataaacatattcgacgacagaccttggcaagaactgcaaagatgctcttgacaatggcatgaataaatattaggtgttatctagaattcaccacatttgaggtcgtgcgcaaagccagatcaaagagaatgcagaacaatagaagcaagaaggatcccaaatatagtgttgcaactctcctcacctgcaggaagggctatacatttccgaagacagagaagaggaaaaaggagggccatggaaaaaggcaagaaggtcccgtgaccaagaaatgaccagctccacagaggaaatgcagggccactctccgactggaccccactgtgcacaaggtgagaattcagcctgtttatcagggtttcccttattaaagtatatgtcaaaaaggcctggtagaaatgtaactctgtgatgttaattttggaaagtctcatctagaactttctgggaagtatttgaaagcacagttgtggaatcatttgaagactcaaacatataaattaaacactcttcttggatacagcagttagaatatggaacagatagggtctacattggagaaatgagagatgtggcaagtgcttagcctctctgagactcagtctcaatgtctccatcagggacagctagctagctcacggaattattgtgagggttcactgttataatttattccaaggtccactgcagcaccgaggacataggtggcactcaagaagcagtggccagtagtattctctgctaaaatatttgccacctcagccactttgattctgctccagagggctttttcgctcatcccattggcgacncaaggcaggttaactaaagatactctcacctaatctaaaaattcaagacatcagtccacaaaataccagaatcaccatggaggcagctgtttagcactttggatagtctatttctccccctaaaaacagcctacttaaaacaggggagagttaaggttccaggatcttactcctgagattttttatttaaagaacaccccatctttactcgcagctgagaggctaagattaaaaattagccactgtatagtagctgagcagtgacaatttttcataaaggtttttagtacacatttgggattataatttcaatattatgcaaatgcattttatggatctataatacagaatgtgtactggcgttaatgtgcattagcaggcgagaagaaaaggctccaaatgagccattttggtgtctgctttcaacatgtattatgaataataagtaaaatgttctggtttagaacaaataatataaaatctgaattcttcttgatgtacatcagtgacaaagccctacgcaactcccatggaattattccattggacacaatttaaaactggctcttaaacaatatattcctgtttctggcttctcttcttgaatgagatgtgaaagtaaaataaatatatttaatatgaatacgggatagttccccccattgctcaaaatcaggcatgaactagatgaaggcattgggaaggctgaaacaccatagtggtcaagagagtggcccaggatacttgtaatttgagaggctctgagtattgaaaagtgaagaagcatctaaatagggttatataacttgcatattttcaatgaataaaattaacaaatataatgcctttaacaaaatatttaatacaagatgactgtattattctgaagatatttaaatgatgtgtaagtaatatttcttaatgtaatgtgctgcaagctttgttccaaaatgggaacttgagttgaaatttgtctgatgtctattttctttcagccttgtcagagtgtttctgtgactgcagattagaataaaattctcacaaactaatttgaggcttttcgtaaaggcagaggactgagccaaacaactagcttctcatgatagagccccaaaatgtttcctttttaattaatatttccatgttgcaattttgcatgtacagaaggtggtagctggttattttagtagtaattcaaactttctatttgcattgatttagttaagactttcagatctattgaccctgtttcttgaatgcatgtttcacaccngccccattcttgggcagcctgcaggaatacaagatcacactgtccaatgagtatggactaagcattcagctgagtaacaataatacaatcatcttgtctctcaaacaggtgcccttaacttaatgttttttaaaatgccaccacgtccatgacatcttcaaaatgatactaaaaatatccatgcgatgagttctgtgtgtgttaagtgttttatatgcattatctcaattgacttccaaagcaacctcacaaggtcagttttacaatccccatgaaatggttgaagaatttggagtctaaaaagactaagtaatttgtacaaaatcacaattatacaggtctaattttgcaacccaaactcttgaccagtatataaccctgaatccagtattaatgtagtagataattgtcttggcttaatttatcatataagttatagaaatggtgttttgtccttactctgacatggggactataattgacactaaaatctgaatcaatttcaaccagtcattgcttcacttcactacttgtctacattgctgcagttggttgctgctttccatttcccccgatgcttttccattcgagatggaggtctgtggaaggaaagatggatacagcaagagggtctatccaagaacccaataaatatgtactgcataaataaatcagatgttttaaatttggcaatttaaattcagcaaaaagtctttgacaacctgtggagtgtaagctatggtttctatccttgcaaccttaaaatttcaaaaagccccaaattcaagcttatcagtagcaaggaagcccttccaaatattaacttacaatcaatattggaaaaaactgagtagtatattgtgtcctattttgaaaacaagctatttgccatgtgtagataagattcctacactaaagatatctttttaatagttgaaatatgagatgccgagtaataaaacttgaagtacantggagcagctctgagagaacaagtggcacattgccttgaaataatactctcaacgccatttgctgagtcttctatgctcttggccctttgcacaatctcacttaatcttcactgcaccctntaaggtaaatattattatcttcattttacagatgaggaaattgaagcttacataaattgtctgaggtcacacagttaataagtggttgaatgtggatttaattcgaggtctgctttatttcaaagtgattcagtgagtgagacagagagaaacaaagagaagacagtggtttttaaagaaagaatgaatctcaattttctgaaaccctatagcaattcctgcctttcttgtggctcttaccatattctgctgttatttctggatttcttatataacctttactgaattataagctattctatttgagagaagagaccacacacaaaccatttctgtattcccccaggaccttgttcagtgcctggaacaaagtaggtattcaagatacctttcacttattcctcatatatttgctgggtgtggttaagcccagtaaagaagacaagtcatgccttccaggagcttctagctcaggggagaaagtgattgaagacccagtgttctaaactgggtgtggcaccacagtgatgggaagtaggggaagccaaggggaagctgactgactggtgggctcaaccaaggtttcccgaggaagaggtcatccaaaaccattcttgaagcttcagtaagagccnagcaaagagggtggggaaagcctcacaaagcgagaaggatcaggaatgcacaaaggccctgaaattagagataagcacaaagcctgtttccaaggattacaaatcacctggagattactggaggacaagagaaaggggagaaacagcaagacagaaggtggcaaggtatccgctgtgaagtctagaaggactgtgtacaccatggtaaagtatttctctatcctgatctttctggggagggtttatgcagaggagaggcaagacaaggcatatatttgagaaagaggatcattagctgaattgtggagaacagactcgaagaggatgctactggttgcagggaacaggaaagaaaaccaaggaagcaatcactaaagccagtgggagggagggtcttgccattagagaagagaaggccattttgtatacacagctgacgcttgaacaacacaggtttgaactgtgagagtccacttatatntggaattttttcaataaaagttacatggagtgtgcctgcctctcctgcctcctcttccacccccgccacccttgagacagcaaaaccaaccattcctcttcctcctcttcctcagcctgctcaatgtgaagatgacgaggatgaaaacctttatgatgatctactcctatttatgtggacttgctctggattagggatgagaagacctgactctactgttttcttgataagtgaccttgaaccagacacatgtgctcaagttccatatctgtaaaatgaagatacctggccttcctacttcacaaggttcttttgaagatcaaatgtaatactgcataataaagtgactcataaattc

SEQ ID NO: 71906 - DNA, 475 bp, Homo sapiens
cagaagtctgattgaagttcttttgctttaatgccattttcagtaccttttgatagagagctcccaagatgagcccaccatgtggtgttcatcatgggttttttttaatgactgggagattagaattactatggtatgtgaatattccttctacaaataactcagttttgggatattctctgagtagttaaacattctaccaatttgattttttttcaacgaaagcttcaagtgcaattaaaacactttgcgtttttctattacactatatgaagataaactaggagtcagtaaggcaattttcaaaacaaagtgttgcagagatactttattctcagtatgtgtattaataacttgactcatctttctcatcaaaccttctccccaccagcacatacctggaggacatccagggtgcaatattgagggttcatctcccatgctctcctctttgtcacctcctctattcaattac

SEQ ID NO: 71907 - DNA, 407 bp, Homo sapiens
ggcaattctaggcaatattttcttaatgtagttagaaaggcaattgcctgacaattgataactataaaatgatagtctaccttaaagagaaagggtaaaacaaaatgatttttctgttaatctcttataattctgtaaaactagttatttttctttcatgaatgaatcacatgaattcatttaagctgatgccgacatatacagtgatcatatgtggaattccactttgatgctgatgcacaccatggtcatgtgaggtattctcctttatagcacttggccctcagttgtgtaaattggttttcaagaatgaattaccaaacctctcaattgtaacatgttgtctaagcgttcccttcaagtttatggcagtaaaaggaatctcttccatgagacataggggcttt

SEQ ID NO: 71908 - DNA, 2247 bp, Homo sapiens
gctgaaattcagggactctttggtggagcaattaccagtcaacttcagggtattatgataaactctgatctggggaggaaccaggactacatagatcaaggcagttttcttctttgagaaactatcccagatatcatcatagagtcttctgctcttcctcaactaccaaagaaaaacatcagcgaagcagcaggccatgcaccccccaaaaactccatctggggctcttcatagaaaaaggaaaatggcagcctggcccttctccaggctgtggaaagtctctgatccaattctcttccaaatgaccttgatcgctgctctgttgcctgctgttcttggcaattgtggtcctccacccactttatcatttgctgccccgatggatattacgttgactgagacacgcttcaaaactggaactactctgaaatacacctgcctccctggctacgtcagatcccattcaactcagacgcttacctgtaattctgatggcgaatgggtgtataacaccttctgtatctacaaacgatgcagacacccaggagagttacgtaatgggcaagtagagattaagacagatttatcttttggatcacaaatagaattcagctgttcagaaggatttttcttaattggctcaaccactagtcgttgtgaagtccaagatagaggagttggctggagtcatcctctcccacaatgtgaaattgtcaagtgtaagcctcctccagacatcaggaatggaaggcacagcggtgaagaaaatttctacgcatacggcttttctgtcacctacagctgtgacccccgcttctcactcttgggccatgcctccatttcttgcactgtggagaatgaaacaataggcgtttggagaccaagccctcctacctgtgaaaaaatcacctgtcgcaagccagatgtttcacatggggaaatggtctctggatttggacccatctataattacaaagacactattgtgtttaagtgccaaaaaggttttgttctcagaggcagcagtgtaattcattgtgatgctgatagcaaatggaatccttctcctcctgcttgtgagcccaatagttgtattaatttaccagacattccacatgcttcctgggaaacatatcctaggccgacaaaagaggatgtgtatgttgttgggactgtgttaaggtaccgctgtcatcctggctacaaacccactacagatgagcctacgactgtgatttgtcagaaaaatttgagatggaccccataccaaggatgtgaggcgttatgttgccctgaaccaaagctaaataatggtgaaatcactcaacacaggaaaagtcgtcctgccaatcactgtgtttatttctatggagatgagatttcattttcatgtcatgagaccagtaggttttcagctatatgccaaggagatggcacgtggagtccccgaacaccatcatgtggagacatttgcaattttcctcctaaaattgcccatgggcattataaacaatctagttcatacagctttttcaaagaagagattatatatgaatgtgataaaggctacattctggtcggacaggcgaaactctcctgcagttattcacactggtcagctccagcccctcaatgtaaagctctgtgtcggaaaccagaattagtgaatggaaggttgtctgtggataaggatcagtatgttgagcctgaaaatgtcaccatccaatgtgattctggctatggtgtggttggtccccaaagtatcacttgctctgggaacagaacctggtacccagaggtgcccaagtgtgagtgggagacccccgaaggctgtgaacaagtgctcacaggcaaaagactcatgcagtgtctcccaaacccagaggatgtgaaaatggccctggaggtatataagctgtctctggaaattgaacaactggaactacagagagacagcgcaagacaatccactttggataaagaactataatttttctcaaaagaaggaggaaaaggtgtcttgctggcttgcctcttgcaattcaatacagatcagtttagcaaatctactgtcaatttggcagtgatattcatcataataaatatctagaaatgataatttgctaaagtttagtgctttgagattgtgaaattattaatcatcctctgtgtggctcatgtttttgcttttcaacacacaaagcacaaattttttttcgattaaaaatgtatgtataaaaaactatt

SEQ ID NO: 71909 - DNA, 2349 bp, Homo sapiens
gctgaaattcagggactctttggtggagcaattaccagtcaacttcagggtattatgataaactctgatctggggaggaaccaggactacatagatcaaggcagttttcttctttgagaaactatcccagatatcatcatagagtcttctgctcttcctcaactaccaaaggctgtcatttccttgaagacatggatcccataacatttattctagtgctttatgacaagttggaattcaatgactatttattaaattgagttctttcagcagaaaaacatcagcgaagcagcaggccatgcaccccccaaaaactccatctggggctcttcatagaaaaaggaaaatggcagcctggcccttctccaggctgtggaaagtctctgatccaattctcttccaaatgaccttgatcgctgctctgttgcctgctgttcttggcaattgtggtcctccacccactttatcatttgctgccccgatggatattacgttgactgagacacgcttcaaaactggaactactctgaaatacacctgcctccctggctacgtcagatcccattcaactcagacgcttacctgtaattctgatggcgaatgggtgtataacaccttctgtatctacaaacgatgcagacacccaggagagttacgtaatgggcaagtagagattaagacagatttatcttttggatcacaaatagaattcagctgttcagaaggatttttcttaattggctcaaccactagtcgttgtgaagtccaagatagaggagttggctggagtcatcctctcccacaatgtgaaattgtcaagtgtaagcctcctccagacatcaggaatggaaggcacagcggtgaagaaaatttctacgcatacggcttttctgtcacctacagctgtgacccccgcttctcactcttgggccatgcctccatttcttgcactgtggagaatgaaacaataggcgtttggagaccaagccctcctacctgtgaaaaaatcacctgtcgcaagccagatgtttcacatggggaaatggtctctggatttggacccatctataattacaaagacactattgtgtttaagtgccaaaaaggttttgttctcagaggcagcagtgtaattcattgtgatgctgatagcaaatggaatccttctcctcctgcttgtgagcccaatagttgtattaatttaccagacattccacatgcttcctgggaaacatatcctaggccgacaaaagaggatgtgtatgttgttgggactgtgttaaggtaccgctgtcatcctggctacaaacccactacagatgagcctacgactgtgatttgtcagaaaaatttgagatggaccccataccaaggatgtgaggcgttatgttgccctgaaccaaagctaaataatggtgaaatcactcaacacaggaaaagtcgtcctgccaatcactgtgtttatttctatggagatgagatttcattttcatgtcatgagaccagtaggttttcagctatatgccaaggagatggcacgtggagtccccgaacaccatcatgtggagacatttgcaattttcctcctaaaattgcccatgggcattataaacaatctagttcatacagctttttcaaagaagagattatatatgaatgtgataaaggctacattctggtcggacaggcgaaactctcctgcagttattcacactggtcagctccagcccctcaatgtaaagctctgtgtcggaaaccagaattagtgaatggaaggttgtctgtggataaggatcagtatgttgagcctgaaaatgtcaccatccaatgtgattctggctatggtgtggttggtccccaaagtatcacttgctctgggaacagaacctggtacccagaggtgcccaagtgtgagtgggagacccccgaaggctgtgaacaagtgctcacaggcaaaagactcatgcagtgtctcccaaacccagaggatgtgaaaatggccctggaggtatataagctgtctctggaaattgaacaactggaactacagagagacagcgcaagacaatccactttggataaagaactataatttttctcaaaagaaggaggaaaaggtgtcttgctggcttgcctcttgcaattcaatacagatcagtttagcaaatctactgtcaatttggcagtgatattcatcataataaatatctagaaatgataatttgctaaagtttagtgctttgagattgtgaaattattaatcatcctctgtgtggctcatgtttttgcttttcaacacacaaagcacaaattttttttcgattaaaaatgtatgtataaaaaactatt

SEQ ID NO: 71910 - DNA, 2188 bp, Homo sapiens
gctgaaattcagggactctttggtggagcaattaccagtcaacttcagggtattatgataaactctgatctggggaggaaccaggactacatagatcaaggcagttttcttctttgagaaactatcccagatatcatcatagagtcttctgctcttcctcaactaccaaagaaaaacatcagcgaagcagcaggccatgcaccccccaaaaactccatctggggctcttcatagaaaaaggaaaatggcagcctggcccttctccaggctgtggaaagtctctgatccaattctcttccaaatgaccttgatcgctgctctgttgcctgctgttcttggcaattgtggtcctccacccactttatcatttgctgccccgatggatattacgttgactgagacacgcttcaaaactggaactactctgaaatacacctgcctccctggctacgtcagatcccattcaactcagacgcttacctgtaattctgatggcgaatgggtgtataacaccttctgtatctacaaacgatgcagacacccaggagagttacgtaatgggcaagtagagattaagacagatttatcttttggatcacaaatagaattcagctgttcagaaggatttttcttaattggctcaaccactagtcgttgtgaagtccaagatagaggagttggctggagtcatcctctcccacaatgtgaaattgtcaagtgtaagcctcctccagacatcaggaatggaaggcacagcggtgaagaaaatttctacgcatacggcttttctgtcacctacagctgtgacccccgcttctcactcttgggccatgcctccatttcttgcactgtggagaatgaaacaataggcgtttggagaccaagccctcctacctgtgaaaaaatcacctgtcgcaagccagatgtttcacatggggaaatggtctctggatttggacccatctataattacaaagacactattgtgtttaagtgccaaaaaggttttgttctcagaggcagcagtgtaattcattgtgatgctgatagcaaatggaatccttctcctcctgcttgtgagcccaatagttgtattaatttaccagacattccacatgcttcctgggaaacatatcctaggccgacaaaagaggatgtgtatgttgttgggactgtgttaaggtaccgctgtcatcctggctacaaacccactacagatgagcctacgactgtgatttgtcagaaaaatttgagatggaccccataccaaggatgtgaggcgttatgttgccctgaaccaaagctaaataatggtgaaatcactcaacacaggaaaagtcgtcctgccaatcactgtgtttatttctatggagatgagatttcattttcatgtcatgagaccagtaggttttcagctatatgccaaggagatggcacgtggagtccccgaacaccatcatgtggagacatttttcaaagaagagattatatatgaatgtgataaaggctacattctggtcggacaggcgaaactctcctgcagttattcacactggtcagctccagcccctcaatgtaaagctctgtgtcggaaaccagaattagtgaatggaaggttgtctgtggataaggatcagtatgttgagcctgaaaatgtcaccatccaatgtgattctggctatggtgtggttggtccccaaagtatcacttgctctgggaacagaacctggtacccagaggtgcccaagtgtgagtgggagacccccgaaggctgtgaacaagtgctcacaggcaaaagactcatgcagtgtctcccaaacccagaggatgtgaaaatggccctggaggtatataagctgtctctggaaattgaacaactggaactacagagagacagcgcaagacaatccactttggataaagaactataatttttctcaaaagaaggaggaaaaggtgtcttgctggcttgcctcttgcaattcaatacagatcagtttagcaaatctactgtcaatttggcagtgatattcatcataataaatatctagaaatgataatttgctaaagtttagtgctttgagattgtgaaattattaatcatcctctgtgtggctcatgtttttgcttttcaacacacaaagcacaaattttttttcgattaaaaatgtatgtataaaaaactatt

SEQ ID NO: 71911 - DNA, 2192 bp, Homo sapiens
gctgaaattcagggactctttggtggagcaattaccagtcaacttcagggtattatgataaactctgatctggggaggaaccaggactacatagatcaaggcagttttcttctttgagaaactatcccagatatcatcatagagtcttctgctcttcctcaactaccaaagaaaaacatcagcgaagcagcaggccatgcaccccccaaaaactccatctggggctcttcatagaaaaaggaaaatggcagcctggcccttctccaggctgtggaaagtctctgatccaattctcttccaaatgaccttgatcgctgctctgttgcctgctgttcttggcaattgtggtcctccacccactttatcatttgctgccccgatggatattacgttgactgagacacgcttcaaaactggaactactctgaaatacacctgcctccctggctacgtcagatcccattcaactcagacgcttacctgtaattctgatggcgaatgggtgtataacaccttctgtatctacaaacgatgcagacacccaggagagttacgtaatgggcaagtagagattaagacagatttatcttttggatcacaaatagaattcagctgttcagaaggatttttcttaattggctcaaccactagtcgttgtgaagtccaagatagaggagttggctggagtcatcctctcccacaatgtgaaattgtcaagtgtaagcctcctccagacatcaggaatggaaggcacagcggtgaagaaaatttctacgcatacggcttttctgtcacctacagctgtgacccccgcttctcactcttgggccatgcctccatttcttgcactgtggagaatgaaacaataggcgtttggagaccaagccctcctacctgtgaaaaaatcacctgtcgcaagccagatgtttcacatggggaaatggtctctggatttggacccatctataattacaaagacactattgtgtttaagtgccaaaaaggttttgttctcagaggcagcagtgtaattcattgtgatgctgatagcaaatggaatccttctcctcctgcttgtgagcccaatagttgtattaatttaccagacattccacatgcttcctgggaaacatatcctaggccgacaaaagaggatgtgtatgttgttgggactgtgttaaggtaccgctgtcatcctggctacaaacccactacagatgagcctacgactgtgatttgtcagaaaaatttgagatggaccccataccaaggatgtgaggcgttatgttgccctgaaccaaagctaaataatggtgaaatcactcaacacaggaaaagtcgtcctgccaatcactgtgtttatttctatggagatgagatttcattttcatgtcatgagaccagtaggttttcagctatatgccaaggagatggcacgtggagtccccgaacaccatcatgtggagacatttgcaattttcctcctaaaattgcccatgggcattataaacaatctagttcatacagctttttcaaagaagagattatatatgaatgtgataaaggctacattctggtcggacaggcgaaactctcctgcagttattcacactggtcagctccagcccctcaatgtaaagctctgtgtcggaaaccagaattagtgaatggaaggttgtctgtggataaggatcagtatgttgagctatcacttgctctgggaacagaacctggtacccagaggtgcccaagtgtgagtgggagacccccgaaggctgtgaacaagtgctcacaggcaaaagactcatgcagtgtctcccaaacccagaggatgtgaaaatggccctggaggtatataagctgtctctggaaattgaacaactggaactacagagagacagcgcaagacaatccactttggataaagaactataatttttctcaaaagaaggaggaaaaggtgtcttgctggcttgcctcttgcaattcaatacagatcagtttagcaaatctactgtcaatttggcagtgatattcatcataataaatatctagaaatgataatttgctaaagtttagtgctttgagattgtgaaattattaatcatcctctgtgtggctcatgtttttgcttttcaacacacaaagcacaaattttttttcgattaaaaatgtatgtataaaaaactatt

SEQ ID NO: 71912 - DNA, 460 bp, Homo sapiens
tcaacatttctggaactcctcttttagagtggccacgagtccctagcacattctttaaaacatccttgagttggcaaatactcctctttccaggataaatttgattttttaaaagaactgccaattattcagtctggtgaatatggtagatgattaaccagattaacatttctggttaataaggtgagattataataaaacaatgataattattttagtgtggctcataaattggtcttgatagtggtatattaaggttaagtaaaggcagcatggtcaccatacagattaaagcccattttagttggtttatgatgtgaatgaattcaggtagcactgggagtcattatatgtttaaatagtattaaaggtttctttttataaaaatcttaattatgacattctctgaaatctggtttcacagtattaaaatgaggctttaaggaaaaacattaaatgg

SEQ ID NO: 71913 - DNA, 486 bp, Homo sapiens
ataacgttacttaatcacagtgcaatatatacccagttttgtactatctatgaacaaccagctagagtgacaagagtggtctgtttcactggaatgcgaagaggacatgtaatattctaaaccttgactttttcctgccaaaagttgctatgttgcatttttagccaaaaaggaatccagtgaacataatctgagtactttgcaattttcctgggttttcggtaactgaaagaccactgagcaagatcctaagagattgtaatgtctagcatggcagccagcagccccatgtgtggttgtttaaatttagattaattacaagtgaaaaaaatttaaaaattttcgggtagcatcttctactcatgaatgtcttttacattttacttgagaaaatcaagctcctcttccgttggctttcttagttgcttgtgtgattattcaaagatgaaaaatgctggagttcagagttccctggtgcttgacacg

SEQ ID NO: 71914 - DNA, 891 bp, Homo sapiens
atccaatatcccggcgtggaacatttcctcggggatccaagtgccctcccgtaaccgctgaaagtcaccccatctgctgagcagccagaagcaagctgatgatgccagtagccagtcaccccgtctgctcggggccagacatggaggagtggggacggacatgtcccaccctcgtctaggtcatgggatgctggccgaaggcccctggcatgggaactgctccgggccaggggttgtggagggctggacaggaaaggaatgaggatcgcctccaccactacagcctcaggagggtggggaggctggatgcgtgccactttaacgagtgtgtatttaccaaatggataaattctgcgcaatgctttgcattccaaataacttgccaccaggtcccttgtgagtctccacctgcctagactgtgagcttcctaagggctggatcacccctgcaaccctagcacctggcatactacctgacccctaacacgcatggatgcctaaggagtgagttcctccgacacctggagaacgagatgcagaggctcgccgggagccccagtgccctgcatgccaatggcacacatcttctccaaacacagcctctctctaaagagctgcctcaaatcagccatgccttgccctgacagctgtttccttcccctgcaaagaccctcgaaagatctcttggctgtgatttgatttgagctcttctggaaggtcctatagagggccttatctaggttgttgaatctttttcagcatctggaaacgggggacagaaacaaatgggagtgtgtctagggggcggcaggcatcatggccccccttcccaggccagggcccacctgtggcaaaggaggccccaaataatagccatcctggttttcttgc

SEQ ID NO: 71915 - DNA, 460 bp, Homo sapiens
ctcctggtagttaccttcatgggtttttccaaattattatttttttagtttttcaagtgggtgcatatattaatacatgtaattttaaaaagcctcttcagtttataatgcaccctaacagtcccctgccccatccctcctaattctccagagcaatgacttttaactcttttagcaatgtcttctatttttttctcacataactacttagtcatttcttgattattttatacattctatagtaatttcttgatatgacagatgaggatttagctcttacaccatcactaccttcacttttccccccatattgtcccaaagtagttaccagatttaggggctaagtagtcaccacatcattatgagtatgtacatattgctcattgttgagaaaaacagagtattatgctcttgcttcctgccttgtgcttccttctgccctagaattaatgattgccta

SEQ ID NO: 71916 - DNA, 515 bp, Homo sapiens
tcaaatcaccaggttcctcaaaaaacaaacaacaacaaaaaaacaacaaaacatgaagaagccaaatctggaggatgagttttccaaattaaacactgaatattgttgtagagtaaaatgatactgtttgtaaagagatgtttttactagacatcctcttcctagccacctattaaggaataactagaatatatattaacagcaagacatcggaaattatctttgcacctgacaaaatgttaagattcagaatttggctggatgctcctaaagagctactgaaatagactcaatgcagctacgatgcccaacagaagcagcgatgcctggtgcacatagcaggttgctagcaggagtcatctggggtgattcacctgtcttgttggtgaggatatggacatcatctggggactctcagaaatccctgaagtgatatagagtcccacatgagcttgcctgtggtgttttacaaaccaataacgtagtgttcataaaccaaagtcacttggaggtaa

SEQ ID NO: 71917 - DNA, 630 bp, Homo sapiens
acaccactgcaccccagcctgggcgacagagtgagactctgtctgaaaacaaacaaactacagctggctgtcctattcttagtccacaatcccttcctccaggtactttctccccttagtcacacagcctctgaaaagggtttgtgtcccaacctaccagaaacctttttaaaaatctattcacacacacacacacaagttttatcaagataaatcctccataccacgggatgggcttttacatttctcaaccggaagtttgccatttcaggctgaatctctgcaatcaagattccgtttatctcacttggcttcctgagccaggactcaggtgtactctcttccctaccccaggagcatcttccagcagcttccctgacctgcttgtacaaatgcccccttccagctgcagagccacaggccacccatggccggcagtggtgtccctgcttcctgctatcaagggcagagaaatattaaagttcaatctcagaacaccctgttatctggtcaagaaatttttaaactactttttatagtaaaaaattaatatgaacacaacctttagtccccaaaccatccacaccgaaagggaaccgctgtcaacagtttcttacacattctcctaga

SEQ ID NO: 71918 - DNA, 273 bp, Homo sapiens
aacagttttccagtatttttttccagccctttgacttaagatactttttaatcacaagtgaacagaaaagaacaatcaaaaaagccctacttattggtattagtgaagaaacaaagctacctgaattgggaattactttaaaactgcactgtagtgtattttagttacataaagtaattaaaattaatgtttagaaaaaagtcttagtccatgatttctgtaactacagagaaggaaaaagagaaaagaagggaaagagagaggtgggtaggg

SEQ ID NO: 71919 - DNA, 1974 bp, Homo sapiens
gccttcgctctctagcttttcttctttcactcccgctcgccgactccagcccgctgggctcacgctctgccggacaccaatcccggcggccctgcccgacggagctcaaggctaggcctggccttgtccgcggagtccgcccctcgccgccaccgggatccgcccccgcgccgacacgcacttccggcagcgccgcggccgggagggaccgagcggggagcaaggcctgcggggaggcgcaggatggacgcgttggctgtcatgatgtaggacctcctgacctagaaccatgcccggcgcagggagaacaacgagcttacggaccgggtgcgggggctgctgtgcgagaaagcctacctgctggcccgggagcgttcgccggcccacctggtggctttccctggacgtttaacggcgactccgcccggcctcccgactttttgatgcaggcgttctcttacatgactttcttcgaggctagattctcgaaagacatcctgaaggtggctttcttaattagctgcctcaccggctggcggagcagttcgtagtcgcctacatcgagagggagagccccgtcctggctcagtactggggcttcgtggacgcgctgtagcgggtcttcgccgtcgtgggtaggaaacagtcgggccggatccccggtgtctggggagcggctgccggccgggcccgcgcgagccgcttcactcctacaagcccggctcactagttccaagctgctggactttgaccctcgctgggaagcttgatcgccgcctgttctcgccaatctctatgcctttgcactgcccagcaacccggtcactgcccaggacctgttaaaagttgaatggacctcccagaatcacgccgctgccaccgccgtttctagagacggcttttggccacctttgagaatcagggtcaaacttggaagggcctgcatttgtcacacttcctcggacactaatttggatagttcaggcccagagacggcttcccgggttagtgtgcctgacaacactgaagaaaaattgtgacattttccttccccagaattacttcgttttatacatttcacttctcttctgaaatcacagcaatgccagtttgcgccttttggtctgaggaacgcaggccctggccactaccaggaaaaagtatttacttttaaaacttgaatgtatatctttaccgtatgcctagtacagtagtgcttggaagaaacagattagtaagacaaaatatatgtcttcaagaacacttacgttctgagaaagaattctgaatgcagattctaatgtctggtaaaatgctttacagtgtaaagaatgcatatatgattcttattttatggcattttaaactttccaccccacggttttaaagtgttaatatatgttaaaaatatatgcaatttataaaggagagggaaagcccagcttgatttttgctgccaaagatggtatatttaaaattaaacgtaactaatggcaaaaaataatgggaatggtgcagtctttgagctgtatccagttggcattattctcttggactaaaaggaatagtattaacttcctcactttgggtaagccactttagatttttgggctgcagttttctcaggtaattagagactttatattatgaaagtttggttcacaattctttgagtctcttttgggaacaaagaaggtaagaggaggatatgtgccctcctctcaatcaaggggtttcttgaaaccctctaaggagaaaaatctgaaactgcctttcctaaaacgttcatgggtttgtcattctgatgatcaatatcgtcccactgaagtatctttttgaattcctagttaggaatctttatgttaagataaactgatcactctctccttcgtggacagtttatctacctaaagatgataggggaaaacactgtttttgaaagacgaaataaagacatgttgtagcaattttatt

SEQ ID NO: 71920 - DNA, 2979 bp, Homo sapiens
gccttcgctctctagcttttcttctttcactcccgctcgccgactccagcccgctgggctcacgctctgccggacaccaatcccggcggccctgcccgacggagctcaaggctaggcctggccttgtccgcggagtccgcccctcgccgccaccgggatccgcccccgcgccgacacgcacttccggcagcgccgcggccgggagggaccgagcggggagcaaggcctgcggggaggcgcaggatggacgcgttggctgtcatgatgtaggacctcctgacctagaaccatgcccggcgcagggagaacaacgagcttacggaccgggtgcgggggctgctgtgcgagaaagcctacctgctggcccgggagcgttcgccggcccacctggtggctttccctggacgtttaacggcgactccgcccggcctcccgactttttgatgcaggcgttctcttacatgactttcttcgaggctagattctcgaaagacatcctgaaggtggctttcttaattagctgcctcaccggctggcggagcagttcgtagtcgcctacatcgagagggagagccccgtcctggctcagtactggggcttcgtggacgcgctgtagcgggtcttcgccgtcgtgggtaggaaacagtcgggccggatccccggtgtctggggagcggctgccggccgggcccgcgcgagccgcttcactcctacaagcccggctcactagttccaagctgctggactttgaccctcgctgggaagcttgatcgccgcctgttctcgccaatctctatgcctttgcactgcccagcaacccggtcactgcccaggacctgttaaaagttgaatggacctcccagaatcacgccgctgccaccgccgtttctagagacggcttttggccacctttgagaatcagggtcaaacttggaagggcctgcatttgtcacacttcctcggacactaatttggatagttcaggcccagagacggcttcccgggttagtgtgcctgacaacactgaagaaaaattgtgacattttccttccccagaattacttcgttttatacatttcacttctcttctgaaatcacagcaatgccagtttgcgccttttggtctgaggaacgcaggccctggccactaccaggaaaaaatcctttgcacatggcctgctatcaacaatcctctacaatgattctcagcatcacctagggagcttatgtaaaatctcaaattcctgggccctatccccagagtttcttatcaagtaagtctgcattgggatctgaggatttgcatctctaacaaaaattcctaggcgatgctcacactgttggtgtaaggtttccttgatggagaactatcaaagcagtcaaagctatcaaaataaaaaagaattctgattgggtgcagtggctcacacctgtcattccagcactttgagaggccaaggtgggcagatcacatgaggccaggagttcaagaccagcctggccaacatggcagaaaccccatctctactaaaaataccaaaattagccgggcatggtggaacacacctgcaatcccagctactcgggaggctgaggcaagagaatcgcttgaacctgggaggcagaagttgcagtgaaacaagttggtgccaatgcattccagcctggatgatggagcgagactctgtctcaagaaaaaaaaaaacaaaaacaaaaacagaactctgcctcatagcgtcttttaagttatacactggacctatcctttcctcactgacagacattttaaaaattttttggtaaggcctagttcatataaaatgtaatccaagccaaaagttaacaagaataaggggaggaaaggggactccaatagcagagaaaggtatttacctgggatatacactgcaagaaaatcaaagctataagaaatgtccatgaatagtagccataaggcatcagagtgataaaattcctgtccctaggagggaatattggagtttgccagagaaacagaatgagagagacagagaggtttattgtaggaattggctcatatgattacggaggctgagaagacccacgatctgccatctgcaagctggagaatcaggaaagctggaggtgtaattcagtcaagtccaatggccagagaagcaagtgtactgatatccaagagcaggagaaaatagatgtcccagaacaagcagagaggctgattttgtccttcctctgcctttttgtttcatatggggcactgaatggactgatgcccatccacattagtgagggtggatcttctttactcagtctaccagtagaaatgtcaatgacttccagaaacaccctcaccaacacacgtggaaataatgttttaccaggtatctgggcatcccttggttcactcaagttgacacaaaattaaccatcacagaaggagactggccttactctgaaattaggaaactaaagaagtgaccagaatggagactaggtagagacaactagttctctaccaaacatgtacagttattcgttggtatctgaaggggattggttccaggaactctcagggataccaaaatctgcaggtgctcaagtcatttatataaaatattacagtatttgcatataacctttgcacatcttccatatactttaaatcatctctacattacttataataatgaatgtgtaaatgctatgaaaatagttactacactattgtttatttgtatttttattgaattgttttggggtggggggcagctgtatctttcttagtaatagaacccctggttttagctgggcacatgactgccctcaataaagattaaagtaccccagccttccttgagattgtggccatgtgactgaactttagacagtgagatataagcagatatcttctgtggcagtgttaggaaactattaaagacagtaagaacattgccctttgccttctttttcctttcttca

SEQ ID NO: 71921 - DNA, 2626 bp, Homo sapiens
gccttcgctctctagcttttcttctttcactcccgctcgccgactccagcccgctgggctcacgctctgccggacaccaatcccggcggccctgcccgacggagctcaaggctaggcctggccttgtccgcggagtccgcccctcgccgccaccgggatccgcccccgcgccgacacgcacttccggcagcgccgcggccgggagggaccgagcggggagcaaggcctgcggggaggcgcaggatggacgcgttggctgtcatgatgtaggacctcctgacctagaaccatgcccggcgcagggagaacaacgagcttacggaccgggtgcgggggctgctgtgcgagaaagcctacctgctggcccgggagcgttcgccggcccacctggtggctttccctggacgtttaacggcgactccgcccggcctcccgactttttgatgcaggcgttctcttacatgactttcttcgaggctagattctcgaaagacatcctgaaggtggctttcttaattagctgcctcaccggctggcggagcagttcgtagtcgcctacatcgagagggagagccccgtcctggctcagtactggggcttcgtggacgcgctgtagcgggtcttcgccgtcgtgggtaggaaacagtcgggccggatccccggtgtctggggagcggctgccggccgggcccgcgcgagccgcttcactcctacaagcccggctcactagttccaagctgctggactttgaccctcgctgggaagcttgatcgccgcctgttctcgccaatctctatgcctttgcactgcccagcaacccggtcactgcccaggacctgttaaaagttgaatggacctcccagaatcacgccgctgccaccgccgtttctagagacggcttttggccacctttgagaatcagggtcaaacttggaagggcctgcatttgtcacacttcctcggacactaatttggatagttcaggcccagagacggcttcccgggttagtgtgcctgacaacactgaagaaaaattgtgacattttccttccccagaattacttcgttttatacatttcacttctcttctgaaatcacagcaatgccagtttgcgccttttggtctgaggaacgcaggccctggccactaccaggaaaaaatcctttgcacatggcctgctatcaacaatcctctacaatgattctcagcatcacctagggagcttatgtaaaatctcaaattcctgggccctatccccagagtttcttatcaagtaagtctgcattgggatctgaggatttgcatctctaacaaaaattcctaggcgatgctcacactgttggtgtaaggtttccttgatggagaactatcaaagcagtcaaagctatcaaaataaaaaagaattctgattgggtgcagtggctcacacctgtcattccagcactttgagaggccaaggtgggcagatcacatgaggccaggagttcaagaccagcctggccaacatggcagaaaccccatctctactaaaaataccaaaattagccgggcatggtggaacacacctgcaatcccagctactcgggaggctgaggcaagagaatcgcttgaacctgggaggcagaagttgcagtgaaacaagttggtgccaatgcattccagcctggatgatggagcgagactctgtctcaagaaaaaaaaaaacaaaaacaaaaacagaactctgcctcatagcgtcttttaagttatacactggacctatcctttcctcactgacagacattttaaaaattttttggtaaggcctagttcatataaaatgtaatccaagccaaaagttaacaagaataaggggaggaaaggggactccaatagcagagaaaggtatttacctgggatatacactgcaagaaaatcaaagctataagaaatgtccatgaatagtagccataaggcatcagagtgataaaattcctgtccctaggagggaatattggagtttgccagagaaacagaatgagagagacagagaggtttattgtaggaattggctcatatgattacggaggctgagaagacccacgatctgccatctgcaagctggagaatcaggaaagctggaggtgtaattcagtcaagtccaatggccagagaagcaagtgtactgatatccaagagcaggagaaaatagatgtcccagaacaagcagagaggctgattttgtccttcctctgcctttttgtttcatatggggcactgaatggactgatgcccatccacattagtgagggtggatcttctttactcagtctaccagtagaaatgtcaatgacttccagaaacaccctcaccaacacacgtggaaataatgttttaccaggtatctgggcatcccttggttcactcaagttgacacaaaattaaccatcacagaaggagactggccttactctgaaattaggaaactaaagaagtgaccagaatggagactaggtagagacaactagttctctaccaaacatgtacagttattcgttggtatctgaaggggattggttccaggaactctcagggataccaaaatctggagctatcgcgcaatagatcctctagagtacctaacta

SEQ ID NO: 71922 - DNA, 2776 bp, Homo sapiens
gccttcgctctctagcttttcttctttcactcccgctcgccgactccagcccgctgggctcacgctctgccggacaccaatcccggcggccctgcccgacggagctcaaggctaggcctggccttgtccgcggagtccgcccctcgccgccaccgggatccgcccccgcgccgacacgcacttccggcagcgccgcggccgggagggaccgagcggggagcaaggcctgcggggaggcgcaggatggacgcgttggctgtcatgatgtaggacctcctgacctagaaccatgcccggcgcagggagaacaacgagcttacggaccgggtgcgggggctgctgtgcgagaaagcctacctgctggcccgggagcgttcgccggcccacctggtggctttccctggacgtttaacggcgactccgcccggcctcccgactttttgatgcaggcgttctcttacatgactttcttcgaggctagattctcgaaagacatcctgaaggtggctttcttaattagctgcctcaccggctggcggagcagttcgtagtcgcctacatcgagagggagagccccgtcctggctcagtactggggcttcgtggacgcgctgtagcgggtcttcgccgtcgtgggtaggaaacagtcgggccggatccccggtgtctggggagcggctgccggccgggcccgcgcgagccgcttcactcctacaagcccggctcactagttccaagctgctggactttgaccctcgctgggaagcttgatcgccgcctgttctcgccaatctctatgcctttgcactgcccagcaacccggtcactgcccaggacctgttaaaagttgaatggacctcccagaatcacgccgctgccaccgccgtttctagagacggcttttggccacctttgagaatcagggtcaaacttggaagggcctgcatttgtcacacttcctcggacactaatttggatagttcaggcccagagacggcttcccgggttagtgtgcctgacaacactgaagaaaaattgtgacattttccttccccagaattacttcgttttatacatttcacttctcttctgaaatcacagcaatgccagtttgcgccttttggtctgaggaacgcaggccctggccactaccaggaaaaaatcctttgcacatggcctgctatcaacaatcctctacaatgattctcagcatcacctagggagcttatgtaaaatctcaaattcctgggccctatccccagagtttcttatcaagtaagtctgcattgggatctgaggatttgcatctctaacaaaaattcctaggcgatgctcacactgttggtgtaagggtgagtacaaattagaaataaaactatttaattctgcctggtgcaaaggagagagagagacttttaccctccacatccttttctttggtcatttactttaggaaacttaattgtaagctttttctgtgcctctttgaaatgcctgtaaatctttccaaaaactaaattaggcttttgccaattttacaacctaagaatgtgaattcctcaaggacctgggagctatctcactgaaatttaatcattgagaaaaatagtacccctatctttcagcttcctggaaacataagagcctaactttattaggcaccttgctccattacaaagctatcttctgtcataaagatacaagaaatttatttttcccttgggacaaaagcaactaactagcagagggtcaccaaaattaccaggtgaatttagggtgaactctgtgtgacaaatggtgctgccaagttctcttgagtactatagaaagtgcatgacatgaattttttacttcatgatggtgcaaaaccattgcttttcactttcagtataatattcaagaaattacatattgaatataagatattcaatatcttattctttattataggctttgtgttatataattttgcccaactaactgtaggctaatgtaagtgttctgaacatgttgaaggtaggttagactaagctctaatgttcagtagggtaggtgtattaagtgcattttcaacttacgaaatttaagctgatatccaaagaatgagtaagaatgaggtaaaggagcaagaaaacattgcttcaggcaaaggaatagtatgtgcaaaagccctggggtttaagaatatgatgtttttagagaactgcaaataattcagtatggttggagcagagggatgtggaatgattattgattctgttggagagtagacagaggccagattgctatgcttagatacaatttcaaccacctacaaatccatctaattacctacatgaccatcatcatctggtcatgtttctccattttatcattatgtataccttaaagacttgctcacattacttaaaattgagataggttaggcatctatccaatctcccatgccagtaattctacagaaacagattaggttagctagataagcatgtttacaattaaatttatgctgtatccttctaatcaccactttctcatcaaaatgctcacaaatcatctgcatcattgtccattctttaaaaatgtataaacccatctctactaaaaatacaaaattagctgggcatgatggcgcacgcctgtaatcccagctgttcaggaggctgaagcagaagaattgcttgaaccccggagacggaggttgcagtcagccgagattgcaccattgctctctagcctgggcaacaagagcaaaactccatctcaaaaaaaaaaaa

SEQ ID NO: 71923 - DNA, 1868 bp, Homo sapiens
taaggaatttcttttttttatttctgacatacttctgtggagtgtgttttgctttcatttttgttgtattgtttgtaatttacactattaacagtttctattagtgctgtggaattaattcctcttgtgctgaagatagaaatatattatttctaggaagaaattgtccttatcgtcttcactaatattggacttagagagtcctcctataagacatgttctgtttttcattttgaacagtttccttgatggagaactatcaaagcagtcaaagctatcaaaataaaaaagaattctgattgggtgcagtggctcacacctgtcattccagcactttgagaggccaaggtgggcagatcacatgaggccaggagttcaagaccagcctggccaacatggcagaaaccccatctctactaaaaataccaaaattagccgggcatggtggaacacacctgcaatcccagctactcgggaggctgaggcaagagaatcgcttgaacctgggaggcagaagttgcagtgaaacaagttggtgccaatgcattccagcctggatgatggagcgagactctgtctcaagaaaaaaaaaaacaaaaacaaaaacagaactctgcctcatagcgtcttttaagttatacactggacctatcctttcctcactgacagacattttaaaaattttttggtaaggcctagttcatataaaatgtaatccaagccaaaagttaacaagaataaggggaggaaaggggactccaatagcagagaaaggtatttacctgggatatacactgcaagaaaatcaaagctataagaaatgtccatgaatagtagccataaggcatcagagtgataaaattcctgtccctaggagggaatattggagtttgccagagaaacagaatgagagagacagagaggtttattgtaggaattggctcatatgattacggaggctgagaagacccacgatctgccatctgcaagctggagaatcaggaaagctggaggtgtaattcagtcaagtccaatggccagagaagcaagtgtactgatatccaagagcaggagaaaatagatgtcccagaacaagcagagaggctgattttgtccttcctctgcctttttgtttcatatggggcactgaatggactgatgcccatccacattagtgagggtggatcttctttactcagtctaccagtagaaatgtcaatgacttccagaaacaccctcaccaacacacgtggaaataatgttttaccaggtatctgggcatcccttggttcactcaagttgacacaaaattaaccatcacagaaggagactggccttactctgaaattaggaaactaaagaagtgaccagaatggagactaggtagagacaactagttctctaccaaacatgtacagttattcgttggtatctgaaggggattggttccaggaactctcagggataccaaaatctgcaggtgctcaagtcatttatataaaatattacagtatttgcatataacctttgcacatcttccatatactttaaatcatctctacattacttataataatgaatgtgtaaatgctatgaaaatagttactacactattgtttatttgtatttttattgaattgttttggggtggggggcagctgtatctttcttagtaatagaacccctggttttagctgggcacatgactgccctcaataaagattaaagtaccccagccttccttgagattgtggccatgtgactgaactttagacagtgagatataagcagatatcttctgtggcagtgttaggaaactattaaagacagtaagaacattgccctttgccttctttttcctttcttca

SEQ ID NO: 71924 - DNA, 1624 bp, Homo sapiens
gccttcgctctctagcttttcttctttcactcccgctcgccgactccagcccgctgggctcacgctctgccggacaccaatcccggcggccctgcccgacggagctcaaggctaggcctggccttgtccgcggagtccgcccctcgccgccaccgggatccgcccccgcgccgacacgcacttccggcagcgccgcggccgggagggaccgagcggggagcaaggcctgcggggaggcgcaggatggacgcgttggctgtcatgatgtaggacctcctgacctagaaccatgcccggcgcagggagaacaacgagcttacggaccgggtgcgggggctgctgtgcgagaaagcctacctgctggcccgggagcgttcgccggcccacctggtggctttccctggacgtttaacggcgactccgcccggcctcccgactttttgatgcaggcgttctcttacatgactttcttcgaggctagattctcgaaagacatcctgaaggtggctttcttaattagctgcctcaccggctggcggagcagttcgtagtcgcctacatcgagagggagagccccgtcctggctcagtactggggcttcgtggacgcgctgtagcgggtcttcgccgtcgtgggtaggaaacagtcgggccggatccccggtgtctggggagcggctgccggccgggcccgcgcgagccgcttcactcctacaagcccggctcactagttccaagctgctggactttgaccctcgctgggaagcttgatcgccgcctgttctcgccaatctctatgcctttgcactgcccagcaacccggtcactgcccaggacctgttaaaagttgaatggacctcccagaatcacgccgctgccaccgccgtttctagagacggcttttggccacctttgagaatcagggtcaaacttggaagggcctgcatttgtcacacttcctcggacactaatttggatagttcaggcccagagacggcttcccgggttagtgtgcctgacaacactgaagaaaaattgtgacattttccttccccagaattacttcgttttatacatttcacttctcttctgaaatcacagcaatgccagtttgcgccttttggtctgaggaacgcaggccctggccactaccaggaaaaaaaccttctggatttcagctttggcaagcttcctctgtttctgagacacctccatcacctgggttacaatcccatccatgattttccccatctccaggcatttttcatggaaagctcctcatgctttttaattccagtttatccatttgtgtggctttaacctccacatccaggtctttctggctaaactgcagtatatccacaatggggccaatggacacataagggaggccctatcacaggaacacgaacacccggagtcgctagaaatcagattccaccggctttgcttcaggccgacttcctaaggaaggcatggtagcatcacagatgctgtttgtctcagtttcctgagaagccagtttcttagagctgtcattcaagagtgggtcaaatttgagatataaaaacctttctcaaggtagactctttggcccctatgcctagtatgtcagctgggcctct

SEQ ID NO: 71925 - DNA, 1468 bp, Homo sapiens
gccttcgctctctagcttttcttctttcactcccgctcgccgactccagcccgctgggctcacgctctgccggacaccaatcccggcggccctgcccgacggagctcaaggctaggcctggccttgtccgcggagtccgcccctcgccgccaccgggatccgcccccgcgccgacacgcacttccggcagcgccgcggccgggagggaccgagcggggagcaaggcctgcggggaggcgcaggatggacgcgttggctgtcatgatgtaggacctcctgacctagaaccatgcccggcgcagggagaacaacgagcttacggaccgggtgcgggggctgctgtgcgagaaagcctacctgctggcccgggagcgttcgccggcccacctggtggctttccctggacgtttaacggcgactccgcccggcctcccgactttttgatgcaggcgttctcttacatgactttcttcgaggctagattctcgaaagacatcctgaaggtggctttcttaattagctgcctcaccggctggcggagcagttcgtagtcgcctacatcgagagggagagccccgtcctggctcagtactggggcttcgtggacgcgctgtagcgggtcttcgccgtcgtgggtaggaaacagtcgggccggatccccggtgtctggggagcggctgccggccgggcccgcgcgagccgcttcactcctacaagcccggctcactagttccaagctgctggactttgaccctcgctgggaagcttgatcgccgcctgttctcgccaatctctatgcctttgcactgcccagcaacccggtcactgcccaggacctgttaaaagttgaatggacctcccagaatcacgccgctgccaccgccgtttctagagacggcttttggccacctttgagaatcagggtcaaacttggaagggcctgcatttgtcacacttcctcggacactaatttggatagttcaggcccagagacggcttcccggaaccttctggatttcagctttggcaagcttcctctgtttctgagacacctccatcacctgggttacaatcccatccatgattttccccatctccaggcatttttcatggaaagctcctcatgctttttaattccagtttatccatttgtgtggctttaacctccacatccaggtctttctggctaaactgcagtatatccacaatggggccaatggacacataagggaggccctatcacaggaacacgaacacccggagtcgctagaaatcagattccaccggctttgcttcaggccgacttcctaaggaaggcatggtagcatcacagatgctgtttgtctcagtttcctgagaagccagtttcttagagctgtcattcaagagtgggtcaaatttgagatataaaaacctttctcaaggtagactctttggcccctatgcctagtatgtcagctgggcctct

SEQ ID NO: 71926 - DNA, 2925 bp, Homo sapiens
gccttcgctctctagcttttcttctttcactcccgctcgccgactccagcccgctgggctcacgctctgccggacaccaatcccggcggccctgcccgacggagctcaaggctaggcctggccttgtccgcggagtccgcccctcgccgccaccgggatccgcccccgcgccgacacgcacttccggcagcgccgcggccgggagggaccgagcggggagcaaggcctgcggggaggcgcaggatggacgcgttggctgtcatgatgtaggacctcctgacctagaaccatgcccggcgcagggagaacaacgagcttacggaccgggtgcgggggctgctgtgcgagaaagcctacctgctggcccgggagcgttcgccggcccacctggtggctttccctggacgtttaacggcgactccgcccggcctcccgactttttgatgcaggcgttctcttacatgactttcttcgaggctagattctcgaaagacatcctgaaggtggctttcttaattagctgcctcaccggctggcggagcagttcgtagtcgcctacatcgagagggagagccccgtcctggctcagtactggggcttcgtggacgcgctgtagcgggtcttcgccgtcgtgggtaggaaacagtcgggccggatccccggtgtctggggagcggctgccggccgggcccgcgcgagccgcttcactcctacaagcccggctcactagttccaagctgctggactttgaccctcgctgggaagcttgatcgccgcctgttctcgccaatctctatgcctttgcactgcccagcaacccggtcactgcccaggacctgttaaaagttgaatggacctcccagaatcacgccgctgccaccgccgtttctagagacggcttttggccacctttgagaatcagggtcaaacttggaagggcctgcatttgtcacacttcctcggacactaatttggatagttcaggcccagagacggcttcccgggttagtgtgcctgacaacactgaagaaaaattgtgacattttccttccccagaattacttcgttttatacatttcacttctcttctgaaatcacagcaatgccagtttgcgccttttggtctgaggaacgcaggccctggccactaccaggaaaaaatcctttgcacatggcctgctatcaacaatcctctacaatgattctcagcatcacctagggagcttatgtaaaatctcaaattcctgggccctatccccagagtttcttatcaagtaagtctgcattgggatctgaggatttgcatctctaacaaaaattcctaggcgatgctcacactgttggtgtaaggtttccttgatggagaactatcaaagcagtcaaagctatcaaaataaaaaagaattctgattgggtgcagtggctcacacctgtcattccagcactttgagaggccaaggtgggcagatcacatgaggccaggagttcaagaccagcctggccaacatggcagaaaccccatctctactaaaaataccaaaattagccgggcatggtggaacacacctgcaatcccagctactcgggaggctgaggcaagagaatcgcttgaacctgggaggcagaagttgcagtgaaacaagttggtgccaatgcattccagcctggatgatggagcgagactctgtctcaagaaaaaaaaaaacaaaaacaaaaacagaactctgcctcatagcgtcttttaagttatacactggacctatcctttcctcactgacagacattttaaaaattttttggtaaggcctagttcatataaaatgtaatccaagccaaaagttaacaagaataaggggaggaaaggggactccaatagcagagaaaggtatttacctgggatatacactgcaagaaaatcaaagctataagaaatgtccatgaatagtagccataaggcatcagagtgataaaattcctgtccctaggagggaatattggagtttgccagagaaacagaatgagagagacagagaggtttattgtaggaattggctcatatgattacggaggctgagaagacccacgatctgccatctgcaagctggagaatcaggaaagctggaggtgtaattcagtcaagtccaatggccagagaagcaagtgtactgatatccaagagcaggagtttgtttcatatggggcactgaatggactgatgcccatccacattagtgagggtggatcttctttactcagtctaccagtagaaatgtcaatgacttccagaaacaccctcaccaacacacgtggaaataatgttttaccaggtatctgggcatcccttggttcactcaagttgacacaaaattaaccatcacagaaggagactggccttactctgaaattaggaaactaaagaagtgaccagaatggagactaggtagagacaactagttctctaccaaacatgtacagttattcgttggtatctgaaggggattggttccaggaactctcagggataccaaaatctgcaggtgctcaagtcatttatataaaatattacagtatttgcatataacctttgcacatcttccatatactttaaatcatctctacattacttataataatgaatgtgtaaatgctatgaaaatagttactacactattgtttatttgtatttttattgaattgttttggggtggggggcagctgtatctttcttagtaatagaacccctggttttagctgggcacatgactgccctcaataaagattaaagtaccccagccttccttgagattgtggccatgtgactgaactttagacagtgagatataagcagatatcttctgtggcagtgttaggaaactattaaagacagtaagaacattgccctttgccttctttttcctttcttca

SEQ ID NO: 71927 - DNA, 1641 bp, Homo sapiens
aaaattttattttctaatatatacctgctggcccgggagcgttcgccggcccacctggtggctttccctggacgtttaacggcgactccgcccggcctcccgactttttgatgcaggcgttctcttacatgactttcttcgaggctagattctcgaaagacatcctgaaggtggctttcttaattagctgcctcaccggctggcggagcagttcgtagtcgcctacatcgagagggagagccccgtcctggctcagtactggggcttcgtggacgcgctgtagcgggtcttcgccgtcgtgggtaggaaacagtcgggccggatccccggtgtctggggagcggctgccggccgggcccgcgcgagccgcttcactcctacaagcccggctcactagttccaagctgctggactttgaccctcgctgggaagcttgatcgccgcctgttctcgccaatctctatgcctttgcactgcccagcaacccggtcactgcccaggacctgttaaaagttgaatggacctcccagaatcacgccgctgccaccgccgtttctagagacggcttttggccacctttgagaatcagggtcaaacttggaagggcctgcatttgtcacacttcctcggacactaatttggatagttcaggcccagagacggcttcccgggttagtgtgcctgacaacactgaagaaaaattgtgacattttccttccccagaattacttcgttttatacatttcacttctcttctgaaatcacagcaatgccagtttgcgccttttggtctgaggaacgcaggccctggccactaccaggaaaaagtatttacttttaaaacttgaatgtatatctttaccgtatgcctagtacagtagtgcttggaagaaacagattagtaagacaaaatatatgtcttcaagaacacttacgttctgagaaagaattctgaatgcagattctaatgtctggtaaaatgctttacagtgtaaagaatgcatatatgattcttattttatggcattttaaactttccaccccacggttttaaagtgttaatatatgttaaaaatatatgcaatttataaaggagagggaaagcccagcttgatttttgctgccaaagatggtatatttaaaattaaacgtaactaatggcaaaaaataatgggaatggtgcagtctttgagctgtatccagttggcattattctcttggactaaaaggaatagtattaacttcctcactttgggtaagccactttagatttttgggctgcagttttctcaggtaattagagactttatattatgaaagtttggttcacaattctttgagtctcttttgggaacaaagaaggtaagaggaggatatgtgccctcctctcaatcaaggggtttcttgaaaccctctaaggagaaaaatctgaaactgcctttcctaaaacgttcatgggtttgtcattctgatgatcaatatcgtcccactgaagtatctttttgaattcctagttaggaatctttatgttaagataaactgatcactctctccttcgtggacagtttatctacctaaagatgataggggaaaacactgtttttgaaagacgaaataaagacatgttgtagcaattttatt

SEQ ID NO: 71928 - DNA, 586 bp, Homo sapiens
gccttcgctctctagcttttcttctttcactcccgctcgccgactccagcccgctgggctcacgctctgccggacaccaatcccggcggccctgcccgacggagctcaaggctaggcctggccttgtccgcggagtccgcccctcgccgccaccgggatccgcccccgcgccgacacgcacttccggcagcgccgcggccgggagggaccgagcggggagcaaggcctgcggggaggcgcaggatggacgcgttggctgtcatgatgtaggacctcctgacctagaaccatgcccggcgcagggagaacaacgagcttacggaccgggtgcgggggctgctgtgcgagaaagcctacctgctggcccgggagcgttcgccggcccacctggtggctttccctggacgtttaacggcgactccgcccggcctcccgactttttgatgcaggcgttctcttacatgactttcttcgaggctagattctcgaaagacatcctgaaggtggctttcttaattagctgcctcaccggctggcggagcagttcgtagtcgccttttctatggacaaaagtcggccctcagga

SEQ ID NO: 71929 - DNA, 449 bp, Homo sapiens
cacgaggcctcgtgccacctcgtgccatggctaccttgtatcttggtctggattctctctctgagaccccggattttactttctctttggagggcgctgggacatacatctctcaatccagcttcctccgcatcctcccatcttgccccatttctgccacgtcagacacttcctgagagtctcaccttcaaaatgacaccgctgcccatccattgctcaatggtacagagtgtggggtcagtccaccacccttgacctcccggcagggcaaggtgaggaggcggacccaaagcagtaccagcaggacttgttgccagtgataccaaaacagacttttcccaagcagtgcctcacatgtctgctggtgtggctttgggattctcctgccccaccccccctcctgatagatcccttctccatgttatgttcttctctccttacattaacat

SEQ ID NO: 71930 - DNA, 403 bp, Homo sapiens
gggtccctccctcctgcctccctgcagccctccttaccagcaactaagtcacagctgtcctacagaaagaatccataagccctgctgctaacaaggtgacctgtggcgcttcttggcactggatgcatggacgaatggagagagggctccagcacaaacaggaaggggaattctctaatctagaacattgctgcttttcactccccaccccgcccctcacatcatactccaatcataaccttgtatattacgcagtcattttggttttcgcggacgcgcctacctaagtaccatttacagaaagtgactctggctgtcattattttgtttatttgttccctatgcaaaaaaaaaatgaaaatgaaaaaagggggattccataaaagattcaataaaagacaaa

SEQ ID NO: 71931 - DNA, 1526 bp, Homo sapiens
cccttgcaagacaggttctggagccaggagcaactgtccagccctccagaagagacagcaagcagcccccctacccactctggcctccccaatggtactttgacctccagtgtagggctatactatacatatatatatatatatatatatatatatataattttggaatttgtttctcataatacagaatatatagtggctaccttgtatcttggtctggattctctctctgagaccccggattttactttctctttggagggcgctgggacatacatctctcaatccagcttcctccgcatcctcccatcttgccccatttctgccacgtcagacacttcctgagagtctcaccttcaaaatgacaccgctgcccatccattgctcaatggtacagagtgtggggtcagtccaccacccttgacctcccggcagggcaaggtgaggaggcggacccaaagcagtaccagcaggacttgttgccagtgataccaaaacagacttttcccaagcagtgcctcacatgtctgctggtgtggctttgggattctcctgccccacccccccgtccatggcagccccctccccaaggctttgctcacacctgagacaggaaggaggaaggggatccaataggaatatgggccccggaggggaagtcatgcacccccaagccaccaccccccagccttccacgcacatctcctggctggaagagagccctccaaaaaggggacacaggctgccccggcccctcaactgcatccacaccccatcctctcatcttgggtcccagccaggcccccccaaaaccaaagccccctcaagtcctggggtcccagcctgtgcccccagcttcctgcccacccagccccgagcattctcacacagagaaagaacaagcaagggctccagggggacaggatggggcagggcatacagtggggggtgggggggcagctgggaggagggagggacaaaacaaaacattttcctttgggttttttttttctttcttttttctcccctttactctttgggtggtgttgcttttcctttccttttccctttgagatttttttgttgttgtttcctttttgtattttactgatatcaccaggatagtttactctccttctagctttctgcttaccgcacactggataacacacacatacacacccacaaaaatgctcatgaacccaatccggagaaggttccagcaggtcccccaccctcccctcctcctcctacttctcctcttgacagcgaggacaggagggggacaaggggacacctgggcagacccgccggctctccccccaccccaccccgcccctcacatcatactccaatcataaccttgtatattacgcagtcattttggttttcgcggacgcgcctacctaagtaccatttacagaaagtgactctggctgtcattattttgtttatttgttccctatgcaaaaaaaaaatgaaaatgaaaaaagggggattccataaaagattcaataaaagacaaa

SEQ ID NO: 71932 - DNA, 1837 bp, Homo sapiens
  misc_feature (1648)..(1648): n is a, c, g, or t
cccttgcaagacaggttctggagccaggagcaactgtccagccctccagaagagacagcaagcagcccccctacccactctggcctccccaatggtactttgacctccagtgtagggctatactatacatatatatatatatatatatatatatatataattttggaatttgtttctcataatacagaatatatagtggctaccttgtatcttggtctggattctctctctgagaccccggattttactttctctttggagggcgctgggacatacatctctcaatccagcttcctccgcatcctcccatcttgccccatttctgccacgtcagacacttcctgagagtctcaccttcaaaatgacaccgctgcccatccattgctcaatggtacagagtgtggggtcagtccaccacccttgacctcccggcagggcaaggtgaggaggcggacccaaagcagtaccagcaggacttgttgccagtgataccaaaacagacttttcccaagcagtgcctcacatgtctgctggtgtggctttgggattctcctgccccacccccccgtccatggcagccccctccccaaggctttgctcacacctgagacaggaaggaggaaggggatccaataggaatatgggccccggaggggaagtcatgcacccccaagccaccaccccccagccttccacgcacatctcctggctggaagagagccctccaaaaaggggacacaggctgccccggcccctcaactgcatccacaccccatcctctcatcttgggtcccagccaggcccccccaaaaccaaagccccctcaagtcctggggtcccagcctgtgcccccagcttcctgcccacccagccccgagcattctcacacagagaaagaacaagcaagggctccagggggacaggatggggcagggcatacagtggggggtgggggggcagctgggaggagggagggacaaaacaaaacattttcctttgggttttttttttctttcttttttctcccctttactctttgggtggtgttgcttttcctttccttttccctttgagatttttttgttgttgtttcctttttgtattttactgatatcaccaggatagtttactctccttctagctttctgcttaccgcacactggataacacacacatacacacccacaaaaatgctcatgaacccaatccggagaaggttccagcaggtcccccaccctcccctcctcctcctacttctcctcttgacagcgaggacaggagggggacaaggggacacctgggcagacccgccggctctccccccaccccaccccgcccctcacatcatactccaatcataaccttgtatattacgcagtcattttggttttcgcggacgcgcctacctaagtaccatttacagaaagtgactctggctgtcattattttgtttatttgttccctatgcaaaaaaaaaatgaaaatgaaaaaagggggattccataaaagattcaataaaagacaaaaaaaaagaaaaaagaaaaaaatgtataaaaatttaaaaaaaaaaaaaaaaaaaaaaaaaaaaaaaaaaaaaaaaaaaaaaaaaaaaaaaaaaaaaaaaaaaaaaaaaaaaaaaaaaaaaaanaaaacccttttttaaattttttaacccccccccccccgggggggggccccccccccccatccccccttttggggggggttaaaaaaatcgggggcgggttttaaacagggggggtgggaaaaaaccggggggccccaaatataaagtttttggaaaaatcccctttttcccagggggggaataaaaggg

SEQ ID NO: 71933 - DNA, 1168 bp, Homo sapiens
cccttgcaagacaggttctggagccaggagcaactgtccagccctccagaagagacagcaagcagcccccctacccactctggcctccccaatggtactttgacctccagtgtagggctatactatacatatatatatatatatatatatatatatataattttggaatttgtttctcataatacagaatatatagtggctaccttgtatcttggtctggattctctctctgagaccccggattttactttctctttggagggcgctgggacatacatctctcaatccagcttcctccgcatcctcccatcttgccccatttctgccacgtcagacacttcctgagagtctcaccttcaaaatgacaccgctgcccatccattgctcaatggtacagagtgtggggtcagtccaccacccttgacctcccggcagggcaaggtgaggaggcggacccaaagcagtaccagcaggacttgttgccagtgataccaaaacagacttttcccaagcagtgcctcacatgtctgctggtgtggctttgggattctcctgccccacccccccgtccatggcagccccctccccaaggctttgctcacacctgagacaggaaggaggaaggggatccaataggaatatgggccccggaggggaagtcatgcacccccaagccaccaccccccagccttccacgcacatctcctggctggaagagagccctccaaaaaggggacacaggctgccccggcccctcaactgcatccacaccccatcctctcatcttgggtcccagccaggcccccccaaaaccaaagccccctcaagtcctggggtcccagcctgtgcccccagcttcctgcccacccagccccgagcattctcacacagagaaagaacaagcaagggctccagggggacaggatggggcagggcatacagtggggggtgggggggcagctgggaggagggagggacaaaacaaaacattttcctttgggttttttttttctttcttttttctcccctttactctttgggtggtgttgcttttcctttccttttccctttgagatttttttgttgttgtttcctttttgtattttactgatatcaccaggatagtttacaatcctggtgatatcagtaaaatacaaaaaaaaacact

SEQ ID NO: 71934 - DNA, 784 bp, Homo sapiens
cccttgcaagacaggttctggagccaggagcaactgtccagccctccagaagagacagcaagcagcccccctacccactctggcctccccaatggtactttgacctccagtgtagggctatactatacatatatatatatatatatatatatatatataattttggaatttgtttctcataatacagaatatatagtggctaccttgtatcttggtctggattctctctctgagaccccggattttactttctctttggagggcgctgggacatacatctctcaatccagcttcctccgcatcctcccatcttgccccatttctgccacgtcagacacttcctgagagtctcaccttcaaaatgacaccgctgcccatccattgctcaatggtacagagtgtggggtcagtccaccacccttgacctcccggcagggcaaggtgaggaggcggacccaaagcagtaccagcaggacttgttgccagtgataccaaaacagacttttcccaagcagtgcctcacatgtctgctggtgtggctttgggattctcctgccccacccccccacttcctcttttaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataa

SEQ ID NO: 71935 - DNA, 272 bp, Homo sapiens
cgccggctctccccccaccccaccccgcccctcacatcatactccaatcataaccttgtatattacgcagtcattttggttttcgcggacgcgcctacctaagtaccatttacagaaagtgactctggctgtcattattttgtttatttgttccctatgcaaaaaaaaaatgaaaatgaaaaaagggggattccataaaagattcaataaaagacaaaaaaaaagaaaaaagaaaaaaatgtataaaaattaaacaagctatgcttcgactc

SEQ ID NO: 71936 - DNA, 896 bp, Homo sapiens
attttagtacattgagaggttttggatcacgattcatcaaatatgtgaattacacttttagttttgtggcatttgcacttggtcattcacgtctctatgttcatacaaatgtcgacagcacggggccacagtagctgccaccagctgcttccctaaaggttaatgccagtctgtgaataaagacaaaggatgtgaactcacctgcctatgtgataattgtcaccacattttctatgccttattcacaaggacaagataaatattctggtgaaataaagctattctgtgtctgcattctggtccgttggtctgtgtaccatatcagaacataaaatgaaattagtttaactgaatgtgtttatatggaatcaactgtctatatgataactgatgcagtgttttctggtttgtactatcatctgaagtgaaaattctttatgtaggctaattttaaaaaatacacaaatctaagctgaattttttttcagtaaaacagactatagtaacttaatggttttattttagtgtttagagaaaaactggtttcattcattgaatttctatagaaggcgtgctattaagcatgatggactgagtgcatttatttcactctgctccttcctaaaatccctttaaaataaaagtaaaagaataaaaagtgcataccaacgggagcaaagagaaaatagagaacatgaagagaagatacagttcaaatgaaagatgccatacaaattttgcaagcaaatggataaattgtaactgacttagagaaatagtgaagttgatcaaaaaaaaaaaaaggtgcttgagaacctcaaagtggcttaggaatttagaacctataaagatgggagtgcagagtaggactgaaaacaggattgattaaaactttt

SEQ ID NO: 71937 - DNA, 1320 bp, Homo sapiens
gaaaatctgaataagggaggctagagagatagaaagacttttactcttcatataataatctttttaaaaaataataaacttttaaaaatactgtcaatattatcctaggaagcatagttttatttctgttttcattaattaatttggacccagcattgatgaagtaaagtttaacttttattttagtttttctctatgttgaatgaacactctttctcccagtttccaattatgttatctacattgagtcactgcttgactccatttccatatttgtagtgttagtccctggtaagacaataaacttccttataagcaaatttagaagcaattatttaattcaagcttgcacaattttctcgagtccagcacgagttgttgccacatctaacaatagcaaagtaaaggttgcaatgcttactagtgatgatttcttgaggaagaaaaataagtcttacttaacaatagaaaccttttttgtcttgctgcccaagtcaccaattttatataggggaagtagttaaaattaactaattatgacaattccggggtaaacttaatttcttagaaatgtttcagagaataatactttctgcctcaaaagtatgcatttattatgtatcaaataaaattttaaatttagagaacattgaagaaatatgagatcagagaaatcaaagattattattaaattacatttcttttggtatctcctgagatttctcagttatgcattacttgtattcattcatttattcatcaaatacaatatttatctaaaacctgctatgaccaagactgggtgaggaactggagacatagctattaaaaaaatagtatttatatttataaatgatgaaacaaaaagaaaaaatagaaggtgaatcggtaggtaaaaagagacaatagactaccagccaatctcaatgtgtgaaccttgtttgtatcctgattcaagaaaagacattaaaaagattatctgaaagagataattaaaaatctgaattctgcctggatagttgatgatattaaagaggtattattcattcttaggtgtaataatgacattgtggttatgttacaaaaaggagtcatttcagaaacagactgaaatatttacaaataaaatcatatgttgtctgggacttacttcaaaataatgtgtgagtgtagggaatgggcagggttgcagtagggacaggattggccatgggttgatggttactgaggctgagcgatggcatgtgaggttttattattttattgtttactctcatctattttcaaaaagttaaaaaatcagccctccctttgctgaaa

SEQ ID NO: 71938 - DNA, 402 bp, Homo sapiens
  misc_feature (398)..(398): n is a, c, g, or t
  misc_feature (401)..(402): n is a, c, g, or t
caaaacctgtataaaaactgaaaaaatgtaaaacgtcacaattagaataagaaaatttaaatagaacaatgaatattaaataaactaaaatgctaataaaatgtactccttagggccaggtgcggtggctcacacctgtaatcccagcactttgggaggccgaggtgggtggatcacctgaggtcaggagtttgagaccagcctggccaatgtggtgaaaccctgtctctactaaaaatacaaaaagttagccaggtgtgatggtgggcacctgtaatcccagctacttgggaggctgaggtgggaggatcacttgggcccggaaggcagaggttgcggtgagcctggatcacggcactgcactccagcctgggcaacaagagcaaatctctgtctcngtnn

SEQ ID NO: 71939 - DNA, 564 bp, Homo sapiens
tggtcatctcagtttcttttctcaccttgactgcaagatgaaactccttgtgctagctgtgctgctcacagtggccgccgccgacagcggcatcagccctcgggccgtgtggcagttccgcaaaatgatcaagtgcgtgatcccggggagtgaccccttcttggaatacaacaactacggctgctactgtggcttggggggctcaggcacccccgtggatgaactggacaagtgctgccagacacatgacaactgctatgaccaggccaagaagctggacagctgtaaatttctgctggacaacccgtacacccacacctattcatactcgtgctctggctcggcaatcacctgtagcagcaaaaacaaagagtgtgaggccttcatttgcaactgcgaccgcaacgctgccatctgcttttcaaaagctccatataacaaggcacacaagaacctggacaccaagaagtattgtcagagttgaatatcacctctcaaaagcatcacctctatctgcctcatctcacactgtactctccaataaagcaccttgttgaaagacca

SEQ ID NO: 71940 - DNA, 566 bp, Homo sapiens
gagggagcaggaaggcagtgtgtccccggggtgctggcagaccgatttgaactctggctatgtcttcttgcagtggccgccgccgacagcggcatcagccctcgggccgtgtggcagttccgcaaaatgatcaagtgcgtgatcccggggagtgaccccttcttggaatacaacaactacggctgctactgtggcttggggggctcaggcacccccgtggatgaactggacaagtgctgccagacacatgacaactgctatgaccaggccaagaagctggacagctgtaaatttctgctggacaacccgtacacccacacctattcatactcgtgctctggctcggcaatcacctgtagcagcaaaaacaaagagtgtgaggccttcatttgcaactgcgaccgcaacgctgccatctgcttttcaaaagctccatataacaaggcacacaagaacctggacaccaagaagtattgtcagagttgaatatcacctctcaaaagcatcacctctatctgcctcatctcacactgtactctccaataaagcaccttgttgaaagacca

SEQ ID NO: 71941 - DNA, 436 bp, Homo sapiens
tggtcatctcagtttcttttctcaccttgactgcaagatgaaactccttgtgctagctgtgctgctcacagtggccgccgccgacagcggcatcagccctcgggccgtgtggcagttccgcaaaatgatcaagtgcgtgatcccggggagtgaccccttcttggaatacaacaactacggctgctactgtggcttggggggctcaggcacccccgtggatgaactggacaagcaaaaacaaagagtgtgaggccttcatttgcaactgcgaccgcaacgctgccatctgcttttcaaaagctccatataacaaggcacacaagaacctggacaccaagaagtattgtcagagttgaatatcacctctcaaaagcatcacctctatctgcctcatctcacactgtactctccaataaagcaccttgttgaaagacca

SEQ ID NO: 71942 - DNA, 612 bp, Homo sapiens
  misc_feature (588)..(588): n is a, c, g, or t
  misc_feature (595)..(595): n is a, c, g, or t
  misc_feature (600)..(600): n is a, c, g, or t
tggtcatctcagtttcttttctcaccttgactgcaagatgaaactccttgtgctagctgtgctgctcacagtggccgccgccgacagcggcatcagccctcgggccgtgtggcagttccgcaaaatgatcaagtgcgtgatcccggggagtgaccccttcttggaatacaacaactacggctgctactgtggcttggggggctcaggcacccccgtggatgaactggacaagtgctgccagacacatgacaactgctatgaccaggccaagaagctggacagctgtaaatttctgctggacaacccgtacacccacacctattcatactcgtgctctggctcggcaatcacctgtagcagcaaaaacaaagagtgtgaggccttcatttgcaactgcgaccgcaacgctgccatctgcttttcaaaagctccatataacaaggcacacaagaacctggacaccaagaagtattgtcagagttgaatatcacctctcaaaagcatcacctctatctgcctcatctcacactgtactctccaataaagcaccttgttgaaagaccaaaaaaaaaaaaaaaaaaaaaattntgggggnggccngggcccgaaaaa

SEQ ID NO: 71943 - DNA, 1037 bp, Homo sapiens
tggtcatctcagtttcttttctcaccttgactgcaagatgaaactccttgtgctagctgtgctgctcacagtggccgccgccgacagcggcatcagccctcgggccgtgtggcagttccgcaaaatgatcaagtgcgtgatcccggggagtgaccccttcttggaatacaacaactacggctgctactgtggcttggggggctcaggcacccccgtggatgaactggacaagtgctgccagacacatgacaactgctatgaccaggccaagaagctggacagctgtaaatttctgctggacaacccgtacacccacacctattcatactcgtgctctggctcggcaatcacctgtagcagcaaaaacaaagagtgtgaggccttcatttgcaactgcgaccgcaacgctgccatctgcttttcaaaagctccatataacaaggcacacaagaacctggacaccaagaagtattgtcagagttgaatatcacctctcaaaagcatcacctctatctgcctcatctcacactgtactctccaataaagcaccttgttgaaagaccacaggcaaacaaaacaaaaaaaaaacaaaaacaacaaaacacactgtgtgtgtggcgcgcgcgccctggggccccgcggagaaaagcttttctagaacaccaattgtcggtgtgggcggcgcgcggaggcgccacagggtggtgaaagtgtgagacacgtggggcgcaataaggcgtgtgtgccccaaagaggagagactcgcggggccaacgagagacaagagcgggcgtggggggattctctctacaccacatagtcaaagaacaagcgcgccccgggggggaacaaccacgagacgcggttctctggagagcaaaaaaatctccaaaaaagggggagagggctccaaagagagggggcaacaatacagggggagagatcataccaccaacaggggagagggccccaaagagcgagagcgcaccgagaaatatctaaaaatatataacgcgcccccgggacaagggaggagc

SEQ ID NO: 71944 - DNA, 253 bp, Homo sapiens
gagtctccacaaatggtctgctttgacacttaccttctactttatgagacagtctgctgcatagctggattattattcctcccaccacagctccagattctattctgtctgaagacaactgtgtgtcttcaccccacaatctctgtatcccctacaacatacggcatttgcttctgcatagtaggtccctaagtaagatgaagaacctgcatctgaaagattatgtggtttgtgcaggatctcaccacacagt

SEQ ID NO: 71945 - DNA, 2875 bp, Homo sapiens
gcctatagctgtgctgaatgcaaggagactttcagcgataacaatcgccttgtgcaacaccagaaaatgcacactgtcaaaaccccatatgaatgtcaggagtgcggagaacgcttcatttgcggctcaaccctgaagtgccacgagagtgttcacgccagagaaaaacaaggattttttgtgagtgggaagatcttggatcagaacccagaacagaaagagaagtgctttaagtgtaacaaatgtgagaaaacctttagctgcagcaaatacctaactcagcacgagaggattcacaccaggggagtgaagccctttgaatgtgaccagtgtgggaaagcctttggccaaagtactcggctcattcaccatcaaagaatccactctagagtgaggctgtataaatggggtgagcaagggaaagccatcagcagtgcctcccttatcaaacttcagtccttccacacaaaggagcacccttttaaatgtaacgaatgcggaaagaccttcagccacagtgcacacctctcaaaacatcagttaattcacgctggagagaatccctttaaatgtagtaagtgtgacagagtcttcacccagagaaactaccttgttcagcatgagcgaactcatgccagaaagaagccgttggtgtgtaacgaatgcgggaaaacgttccgtcagagctcatgcctttctaagcatcagagaattcactcaggtgagaagccctatgtatgtgattactgcgggaaggccttcggcctgagtgctgagcttgtccgccaccagagaattcacactggagaaaagccttatgtttgtcaggaatgcgggaaagccttcacccagagctcatgcctttctattcaccggagagttcacactggggagaagccctacagatgtggtgaatgtgggaaagcctttgcccagaaagcaaatctaacacagcaccagagaattcacacaggggagaagccttactcctgtaatgtgtgtggcaaagcttttgtcctcagtgcccatctcaaccagcacctgagagttcacacccaggagacactttatcagtgtcaacgttgccagaaagcctttcggtgccactcgagcctcagccgccatcagcgtgtacacaacaagcagcaatactgcctgtagccattgggtggcagcagagtcccagaatatgagaccgttactcggatgttgaaagttggaaactatcccattgcaagtttctctccaaataaatgcatctaaagattgattagaaagtttgtgcgcatgtttttcattataacaatgaaaacacaaaagtggagaagctgtacaacgtcaggattcagaggtaggctctggagccagtctaccttgagttaaatcccacctctgccatctactacctaagtgaccttgggaaggtcagaaaaatctctcagggcctcggtgtccttatctgtaaaatgggcatcacctacctcagagggcttttctgaggattaaataaataaatgtgaagcacttagaactgatggccagcacatgagggctcaccaagtgtaagccacaaatacacatcagctatagcacaaatatacttgtgttacaagaaaggaattagtaatctgtgtttactgtagttaatgttcttacaatgtatcgcttttaatttaagttttccttttttacagtttttctccagcactttactcttcttaagtgcctggcctttttttgtccctttatctctcctggtttttttcttaagccccagaaagccaaaaagaacatgtaaactcttcacctcaactagctacaaccttccactcctaacctcccaagcttctcacttaaagaggactccctatcccacaaacacatgctccctcttcctatgaccttcctccatttaacagtgttggttatgcaataagacacccaatttttcatgggagttgacaccaaaacacagctggattccatcaggaaagctgcattgatcagggtgttaaccgcatatgaaacaacccatatggaagacatacttaggggtcaaacctgtggtgtgtggaagtgaccactgggatgtcatcattcaccatttatccaggatggccgctcaccaggcaatttgctaggctcgggggcgggtagtatccatacactatgcactactgctctgaagcttctggaatcagaaatgaacccattttcatcgacgattgctgttagttgacaagtgacatcttgaaaatgccacattccctcatgtcacaggaagttctgggatcaccaaggattgttggagagtccagtgagatggaaccacacaaccagttccctaccagtgtcttgtcagctctgggtgtttgttccctgccactaagtggctcagtcacacctttgctgaaacacagtagtcttatgaaaagcactggacacatactttgaatacctttcatattttaggtgctgaaaatggtgagggagtgagtgctctgcacccttgggcttttcaactcttgcacctggagttctgctggttaagtttgttaaacttagttgaaactgggaacctgttggctaaccattggggccttacactgtttttcaaatggttgcaacatttaacttctcgcacatggttcccgtcctctggagctctgtcttgtcggggagatgggcatgttgtataccaaaagagtgtacaaagtgttgcagggctgtgacacaatagggactctatggaaaactggcagccattgggtgtgggggcagtctgtaaatcagtcacctgtgttgctgcaggccaaggtagaaacgccctccgtgtgtgcatatttgttggttctctgattaaagttttgagtct

SEQ ID NO: 71946 - DNA, 312 bp, Homo sapiens
cgagatcacaccactgcactccagcctgggcaacagagtgagattccacctcaaaaacaaaacaaaacaaaaaacctgaagccaaataaacttgtccattatgaacttacaggccctctgtgcctccaactcacctttttcaacgcttcctacctccctgtggtgttcaaaaatctgttttattgtacaccctcttctctcatcttcactttcagatacttcaaacatctgacctcatggttgttttttttttgagatgtcttgctgtgtcacccaggctggagtgcagtggtgcaatctcggctcactgca

SEQ ID NO: 71947 - DNA, 365 bp, Homo sapiens
aatataaaacctcaggcatttatttcatagaactctttccagggaaagctatagatgcagtatagccaactcaaaacactccttcttccctgttcctcctcaagccttacactcagtgcccaaacccatgggttccacctcagaaacatctcttaagtccactccttcctctagccccatgtccccaactgcagcctcatttcccgctttcaggaactcaggttcaggagctcctaactttcatcgtacactttttacaacttggtgcctttgtaatactgctgcttctgcctggaagccactgggttaagagcacagactcagaagccggactgtctgagctccaattctgactgaacgtctgc

SEQ ID NO: 71948 - DNA, 3401 bp, Homo sapiens
actttagtcaagtaagcacaaaaaggaatatataattccaaattgtgataaatgctatgaagaaaaggaatgtgctctgacataaaggggggaacgaacgtgatctagggagtcagagatctctccgagaagagatctgaaataggagtaagtcgagagggggaagagaatgctagaccgagggaacagtgcgtgccaaagccgcgtggcggaaaggggcgtgtgggagggtaactgcggagagggagggtagaggacgaagccggagaggcagacgaagggcaggacgcacagagccccgcggctaccgccttaggggttgtcccggcggtggggaagccattgaggagtttaacgccggaaggtggtgactaatcagatttcacttgaaaatggcacggtgtctgcagcgaggctaactgatgggaagggcccagcgaatgccaataggagagagcaccggacctggaaggcctgggtcaacgcggccccgcgcgggggcgaagcggttccggcgcaggggcctggcgcggggctccgcggaaaaccgaaccggcccacgtgggaccggtcgctccgccctgctgcgcagacgccgcctgactccgcagtccgggactggggctgggcgcgctgcccgggagccccgcacccacgcctggaccgcggagacgcccaggccgaggaacccccagcccagggactagacaccaccagggccgggcggagccagagccagacgcgccggagcgggcgcctctacgccggttggatagcagttggatctgggctgaagacagatctgagagtcaccagcatatgatggtctttgaagctacagcagagaatgaggtcctctggagagaaatgcacaaaatcagaagacagcctggctctgaggacggaggaaaaaccctttgcaggagactgagaatgaacaggctagatgttcgccatccagccagggctagctgaggggggccaattcctgggggacccacctcctggattatgtcagcccgagctccaaccagacagcaactccaacttcatggcaagtgccaaggatgctaacgagaattggcatgggatgccaggcagagtggaacctatcctgaggaggagctcctctgagtcaccctctgacaaccaagccttccaggcccctggatcccctgaggaaggggtgcgcagccccccagagggggcagagattcccggggctgagcctgagaagatgggtggtgctggcacagtctgctcccctctggaggacaacggctatgccagcagttccctgagcattgacagccgtagcagcagtcctgagcctgcctgtgggaccccgcgaggccctggccctcccgatccccttctgccctcagtggcccaggctgtgcagcacttacaagtccaggagcgctacaaagagcaggagaaggaaaagcaccacgtgcacttggtgatgtaccgtcgcctggcactgctccagtggatccggggcctgcagcatcagttgattgaccagcaggcccgactgcaggagagcttcgacaccatcctagacaaccggaaggagcttattcgctgtctccagcagagggcagcaccatccaggccccaggaccaggcctaagggtgtgcctccacaagtgtgcaagggtatatgtatatatttgcaggcatgtgtgaggcgcactagtaagtacataatttgctggcatgattgcaggtaggcatgagtgtgtatgtgctaacatgtaggctggtgtgtgtaggcatgtgtgaataagcatgtataaatgagcttaagtgtgctgtgtgcacatgtgtacacacagctaatttatctgcagacctatatgtgagcatgtaagagtgaacatatgtgtgtgtgtgtagtatgtaagaatgaggaactcggtatgtgcatgtgtagacaggtacccagcagtgtgtgtatatgcgcatgagtgaggatgtataggcagaagatgtgtgtgtctatgagtgagtttgagtgtgcaggcttgtattaggtgtatgtgaggaagcccttgtgtgtgcaggggtgcacatgtttggccacaggcatgggaggtgtatgttaggagcatgtgtgtttgtaggcagactcatgagcaggtgtgtgcaaatacatatccagctgcactgtgggtgtccacccacaccttgtgttcctcatggcctaccccagcctttcttctccactgggtcccactgttccctggagacagagggctagcatgctgtcatttatctgaaggttgtggctgacccattctcctgggatttcccaggccacctctcctttccctttccctcacttaacccagacttgctcagctgaggctattgtccctgatgttggctttacttgtaggaggtttagtggctgctctggcctgccatggaattttggctgcaattttggcagtgtgtggagaactggtatcaggaaagggaaccaggagtagtgatgaagatgatggtggggatggggacagaggacataggggactgtccctcttgaactctgcctttgggcacatgggagatggggacaggaaagatgataacagtggaaccctgtgaagaataggagaatgggaattctaaaataccagttcccaaacaaaccatctctccattggaaaaggagctgttgcaaaccgtgttcatttaagcttctgatgaaaagcaatgtatgtttataagcttgcaagtaacagacaagatgttccaaggccgatgaggaaaatatcgcttccctgtctctgcctctaccttgctgtgcctctctggctttagcagcattggatgttgaattggtttggttcatttctctgaagtcggactgtcaggaggagccagaggttggctttctgggatgtgaaggggacagtgtcagcctaagcctctggagatgcttaggatgctgaattttaaccccttctttcactgcatggcccttcaaacagggattggcaggctccgcgagttacagagtgggtgagtcttggagagaaccaacgactaaggtagcttagctctctgctttgttcttgggagccaagagaatgcaagatcctggtgggtgagcagtggtatgaagaggggacactggtgggtgaacagtggcatggaagtcactgatgcagcctctggccctcagtctccctatcggcaaagtggggggctcttcctatctctaaagagtttcatccctgacaggtggatgggtgaaagatccagagagtgggggtgaggggtgggccctgaagactttttgtctgtagctcttgcatattgagtgtataaacccggcttctggaccaacccaagatgaataaactggggcagaaaattacaaaaaaaaa

SEQ ID NO: 71949 - DNA, 3226 bp, Homo sapiens
actttagtcaagtaagcacaaaaaggaatatataattccaaattgtgataaatgctatgaagaaaaggaatgtgctctgacataaaggggggaacgaacgtgatctagggagtcagagatctctccgagaagagatctgaaataggagtaagtcgagagggggaagagaatgctagaccgagggaacagtgcgtgccaaagccgcgtggcggaaaggggcgtgtgggagggtaactgcggagagggagggtagaggacgaagccggagaggcagacgaagggcaggacgcacagagccccgcggctaccgccttaggggttgtcccggcggtggggaagccattgaggagtttaacgccggaaggtggtgactaatcagatttcacttgaaaatggcacggtgtctgcagcgaggctaactgatgggaagggcccagcgaatgccaataggagagagcaccggacctggaaggcctgggtcaacgcggccccgcgcgggggcgaagcggttccggcgcaggggcctggcgcggggctccgcggaaaaccgaaccggcccacgtgggaccggtcgctccgccctgctgcgcagacgccgcctgactccgcagtccgggactggggctgggcgcgctgcccgggagccccgcacccacgcctggaccgcggagacgcccaggccgaggaacccccagcccagggactagacaccaccagggccgggcggagccagagccagacgcgccggagcgggcgcctctacgccgctagatgttcgccatccagccagggctagctgaggggggccaattcctgggggacccacctcctggattatgtcagcccgagctccaaccagacagcaactccaacttcatggcaagtgccaaggatgctaacgagaattggcatgggatgccaggcagagtggaacctatcctgaggaggagctcctctgagtcaccctctgacaaccaagccttccaggcccctggatcccctgaggaaggggtgcgcagccccccagagggggcagagattcccggggctgagcctgagaagatgggtggtgctggcacagtctgctcccctctggaggacaacggctatgccagcagttccctgagcattgacagccgtagcagcagtcctgagcctgcctgtgggaccccgcgaggccctggccctcccgatccccttctgccctcagtggcccaggctgtgcagcacttacaagtccaggagcgctacaaagagcaggagaaggaaaagcaccacgtgcacttggtgatgtaccgtcgcctggcactgctccagtggatccggggcctgcagcatcagttgattgaccagcaggcccgactgcaggagagcttcgacaccatcctagacaaccggaaggagcttattcgctgtctccagcagagggcagcaccatccaggccccaggaccaggcctaagggtgtgcctccacaagtgtgcaagggtatatgtatatatttgcaggcatgtgtgaggcgcactagtaagtacataatttgctggcatgattgcaggtaggcatgagtgtgtatgtgctaacatgtaggctggtgtgtgtaggcatgtgtgaataagcatgtataaatgagcttaagtgtgctgtgtgcacatgtgtacacacagctaatttatctgcagacctatatgtgagcatgtaagagtgaacatatgtgtgtgtgtgtagtatgtaagaatgaggaactcggtatgtgcatgtgtagacaggtacccagcagtgtgtgtatatgcgcatgagtgaggatgtataggcagaagatgtgtgtgtctatgagtgagtttgagtgtgcaggcttgtattaggtgtatgtgaggaagcccttgtgtgtgcaggggtgcacatgtttggccacaggcatgggaggtgtatgttaggagcatgtgtgtttgtaggcagactcatgagcaggtgtgtgcaaatacatatccagctgcactgtgggtgtccacccacaccttgtgttcctcatggcctaccccagcctttcttctccactgggtcccactgttccctggagacagagggctagcatgctgtcatttatctgaaggttgtggctgacccattctcctgggatttcccaggccacctctcctttccctttccctcacttaacccagacttgctcagctgaggctattgtccctgatgttggctttacttgtaggaggtttagtggctgctctggcctgccatggaattttggctgcaattttggcagtgtgtggagaactggtatcaggaaagggaaccaggagtagtgatgaagatgatggtggggatggggacagaggacataggggactgtccctcttgaactctgcctttgggcacatgggagatggggacaggaaagatgataacagtggaaccctgtgaagaataggagaatgggaattctaaaataccagttcccaaacaaaccatctctccattggaaaaggagctgttgcaaaccgtgttcatttaagcttctgatgaaaagcaatgtatgtttataagcttgcaagtaacagacaagatgttccaaggccgatgaggaaaatatcgcttccctgtctctgcctctaccttgctgtgcctctctggctttagcagcattggatgttgaattggtttggttcatttctctgaagtcggactgtcaggaggagccagaggttggctttctgggatgtgaaggggacagtgtcagcctaagcctctggagatgcttaggatgctgaattttaaccccttctttcactgcatggcccttcaaacagggattggcaggctccgcgagttacagagtgggtgagtcttggagagaaccaacgactaaggtagcttagctctctgctttgttcttgggagccaagagaatgcaagatcctggtgggtgagcagtggtatgaagaggggacactggtgggtgaacagtggcatggaagtcactgatgcagcctctggccctcagtctccctatcggcaaagtggggggctcttcctatctctaaagagtttcatccctgacaggtggatgggtgaaagatccagagagtgggggtgaggggtgggccctgaagactttttgtctgtagctcttgcatattgagtgtataaacccggcttctggaccaacccaagatgaataaactggggcagaaaattacaaaaaaaaa

SEQ ID NO: 71950 - DNA, 3062 bp, Homo sapiens
actttagtcaagtaagcacaaaaaggaatatataattccaaattgtgataaatgctatgaagaaaaggaatgtgctctgacataaaggggggaacgaacgtgatctagggagtcagagatctctccgagaagagatctgaaataggagtaagtcgagagggggaagagaatgctagaccgagggaacagtgcgtgccaaagccgcgtggcggaaaggggcgtgtgggagggtaactgcggagagggagggtagaggacgaagccggagaggcagacgaagggcaggacgcacagagccccgcggctaccgccttaggggttgtcccggcggtggggaagccattgaggagtttaacgccggaaggtggtgactaatcagatttcacttgaaaatggcacggtgtctgcagcgaggctaactgatgggaagggcccagcgaatgccaataggagagagcaccggacctggaaggcctgggtcaacgcggccccgcgcgggggcgaagcggttccggcgcaggggcctggcgcggggctccgcggaaaaccgaaccggcccacgtgggaccggtcgctccgccctgctgcgcagacgccgcctgactccgcagtccgggactggggctgggcgcgctgcccgggagccccgcacccacgcctggaccgcggagacgcccaggccgaggaacccccagcccagggactagacaccaccagggccgggcggagccagagccagacgcgccggagcgggcgcctctacgccgctagatgttcgccatccagccagggctagctgaggggggccaattcctgggggacccacctcctggattatgtcagcccgagctccaaccagacagcaactccaacttcatggcaagtgccaaggatgctaacgagaattggcatgggatgccaggcagagtggaacgacaacggctatgccagcagttccctgagcattgacagccgtagcagcagtcctgagcctgcctgtgggaccccgcgaggccctggccctcccgatccccttctgccctcagtggcccaggctgtgcagcacttacaagtccaggagcgctacaaagagcaggagaaggaaaagcaccacgtgcacttggtgatgtaccgtcgcctggcactgctccagtggatccggggcctgcagcatcagttgattgaccagcaggcccgactgcaggagagcttcgacaccatcctagacaaccggaaggagcttattcgctgtctccagcagagggcagcaccatccaggccccaggaccaggcctaagggtgtgcctccacaagtgtgcaagggtatatgtatatatttgcaggcatgtgtgaggcgcactagtaagtacataatttgctggcatgattgcaggtaggcatgagtgtgtatgtgctaacatgtaggctggtgtgtgtaggcatgtgtgaataagcatgtataaatgagcttaagtgtgctgtgtgcacatgtgtacacacagctaatttatctgcagacctatatgtgagcatgtaagagtgaacatatgtgtgtgtgtgtagtatgtaagaatgaggaactcggtatgtgcatgtgtagacaggtacccagcagtgtgtgtatatgcgcatgagtgaggatgtataggcagaagatgtgtgtgtctatgagtgagtttgagtgtgcaggcttgtattaggtgtatgtgaggaagcccttgtgtgtgcaggggtgcacatgtttggccacaggcatgggaggtgtatgttaggagcatgtgtgtttgtaggcagactcatgagcaggtgtgtgcaaatacatatccagctgcactgtgggtgtccacccacaccttgtgttcctcatggcctaccccagcctttcttctccactgggtcccactgttccctggagacagagggctagcatgctgtcatttatctgaaggttgtggctgacccattctcctgggatttcccaggccacctctcctttccctttccctcacttaacccagacttgctcagctgaggctattgtccctgatgttggctttacttgtaggaggtttagtggctgctctggcctgccatggaattttggctgcaattttggcagtgtgtggagaactggtatcaggaaagggaaccaggagtagtgatgaagatgatggtggggatggggacagaggacataggggactgtccctcttgaactctgcctttgggcacatgggagatggggacaggaaagatgataacagtggaaccctgtgaagaataggagaatgggaattctaaaataccagttcccaaacaaaccatctctccattggaaaaggagctgttgcaaaccgtgttcatttaagcttctgatgaaaagcaatgtatgtttataagcttgcaagtaacagacaagatgttccaaggccgatgaggaaaatatcgcttccctgtctctgcctctaccttgctgtgcctctctggctttagcagcattggatgttgaattggtttggttcatttctctgaagtcggactgtcaggaggagccagaggttggctttctgggatgtgaaggggacagtgtcagcctaagcctctggagatgcttaggatgctgaattttaaccccttctttcactgcatggcccttcaaacagggattggcaggctccgcgagttacagagtgggtgagtcttggagagaaccaacgactaaggtagcttagctctctgctttgttcttgggagccaagagaatgcaagatcctggtgggtgagcagtggtatgaagaggggacactggtgggtgaacagtggcatggaagtcactgatgcagcctctggccctcagtctccctatcggcaaagtggggggctcttcctatctctaaagagtttcatccctgacaggtggatgggtgaaagatccagagagtgggggtgaggggtgggccctgaagactttttgtctgtagctcttgcatattgagtgtataaacccggcttctggaccaacccaagatgaataaactggggcagaaaattacaaaaaaaaa

SEQ ID NO: 71951 - DNA, 596 bp, Homo sapiens
acacacatatttatggtctgcacaaatgggtatatgccagagtgaacatgaaagtaaattacatcttacccgaatctgattctaatcagaaaacagccaagaacataacaccttttcctgctttcagtggagctggtgggacaaacctggactgggtggagctggggccccagcagtgggctctgccatagcaggcgccataagctggaatttgtgcctccaggcctggagggacgcaaggcgtttctgatgaagccgatacattcagaattggggtccaaataggaaataatgcccttttcaggctagtgaaaatgttgaactctaagagataagtttatttagagactggattgagcttttgtttaagatttcccacctgcgtaaaattcctttcagcccataggattcttgattctgaagtccagacagaagcctgtgttctgtagctgctgaacaaagatgagagatcactggggctgctgtttgtccgaagtttgtgtgggtatcatgatgaaccctcttctaagaagtaaaaggatcttttaaatcaaaatagacaactgcagtcagtccaccatgcccaacgacattta

SEQ ID NO: 71952 - DNA, 546 bp, Homo sapiens
aggagatcttcaaataatctccttctcttcctacaatctccactctcccaggactgccctctttgtgaggcttctggaacttcacacatctggcctcaatttcaccagtgcaagcatatctgcacgcctctccaatcttatcctcccaggtccccttcttaacgccagtgggtctggtctcctctttctagcaaatatctttttctctctgttgctggttgagccctcccaacagacatgtatctggcagagttgggacattgagtgtgggggttggggggaacatgtgacatctttggaatctgacggtcccagagtggatttttggaaatctagtgttgggtggttttagtgggctgagacagaattgaaagggaatgtcttggttggggttatttgcacatttcttctctgctggggcagagcaaattaagctttgattatctgatagattaactgtaaagctactgctctttataaatttaacaccttttgttacttctgagttttcttctaagccactggacccatccgtaaaaaaaaaaa

SEQ ID NO: 71953 - DNA, 343 bp, Homo sapiens
acactcacacggtcacacggagaccgaggctatgagcgctcgaacagcagagacatgctcttccccaggggtctccctgagaccacagagcctctcgcgtgctcactgcaatcttctcaagtcaacagcaggaaggaactcaaccagtaacaccaggatcctttgagatcctctaaagtgggccaaagtggtgcccctggaggagccctcctgtcaccatggtaaccctctcacacctctcctgctgggctttcccgggataccacccaggggcctggagcggctgcatgtgtgcatggcggcctcctgaggacccagccacacaccactggtgttgcctcgg

SEQ ID NO: 71954 - DNA, 8443 bp, Homo sapiens
  misc_feature (2)..(2): n is a, c, g, or t
  misc_feature (8)..(8): n is a, c, g, or t
antctggntcggaggaatctcagtagggacaacaggcaggagaatatgggagcgcatttccccaggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggagggaaaaagaaatacagcctcaacagattaaaaaacaaaagtcacacttaaggatccttctagtcacatcagcagtgttctgcctttatgtagtagttgggcatataatccttccacacagcccctgcagggaaaggctaatcttacggataatccacgtgagatttccacacaagagaaaagcacacgcatagtgaaatgtcagtcttttcagtaatgaggatacctttaaggcactcttggactctcggcaaccacaacataatagttgaaagatcaagattggctccacgaaagtgatacggaggttaggatgctacttgctgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgtcaagggatatatttctatccctgccagcacagtgctggacatagtgagtactgaacacctaagaggcactcattcagactgacttctacaggacttctacgtgtgtgataaaagcctgtgaatcgtgagtccctgaaatatggtagcctggcccagcttctaaagaggaccttcgtagccacaaggcatgctaaacctctagggtctgatgctgtttttgttccaaatataaacgaaaggcactagtcagccgcctgcatagactttctaaacagtgagtaaataccatggaatgtcagaaatgactttatcatcgtcatcttgaagaaaaatatgaacactgatgaaggtcattttttttttttgacatctttctgtggcaaagctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaaaagcattaattgttcactggcaattactaaatgtattttgttgctctgagaaactcagcagtgtactgagatgtggctggctgtgccatcgtcatagtgcacagtgacttttctgtttcttatcactaaagactgaggtgaggttatgaaactttcattggtcccatcgttgtgcgcagggtgcaactggctacctagaagctgatggcaggagactgtttcacacacaggagattgtgagctgtgtaagtagtcatcgccactcaagtaggacaagggtcctacccaaggctaggaccgccctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacgaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatctcaaaaaaaaaaaaaagaaagaaagaaactgaaaagtgaggtgtggaactccaggcaacgacccaagcacttattttttaagagggaaaggactttggtcatgtttacattggcctttggtttttttttttctttcagccacaactatatgctgatataactcagccatcacttttgagttttgtttttaaatgaaggttaaatgtgacctgtgccctcacatttaattccgtttcatggagacatcttcctgactttgttggatagctgccactagggttgcttcgatcttcagccacatgctgtccttgaagcagctatttgaagatgtgttttctgaggaaaacaggctacaactgtttattaaaaccacttgcagtgcattcgtttatcagatgctcagtgcaaagtgtaattgggtcatggtcaaaaacgcttgcaacatctaattggcgttcaagatagtcattcaaaagttcttggcccgctgaagtctgttaacagttgaaacattctacagttaaccattagcatgctagttgtcctaatggaaatttttgaagagtttttcaatatataccctacccttgccaggaagagaagtaaaatcctcaggttgtggggtatttgtttctactccagcctggcaggcaaggctaaaacctgagattatcgatctatgagacatcttgatatgtaaagcacttaatattaaaggcataaaagtgaaactgctaaatatgtatagagaggttgacgtgtgatacgtgggacagttcacatagacatcagagaatttattccagaaaggagcctcctgaatgtgatgaatacggcaaagcctttaatcacatctcagcccttagcatcggaaagcttatactgtaaataaacttgatgaatattatatgtgaggaaaactttcatgtatagcactcattgcttcagacagaaaatgaattccgtcggtatgttccaatcgtgatgaatttgagaaacattgcaagagggagctcaatcttggccgggcgcagtggctcacgcctgtaatcgcagcactttgggaggccgaggcaggcggatcacgaggtcagtagttcgagaccagcctggccaacatggtgaaaccttgtctctactaaaaatacaaaaaaaaattagctgggcacagtggcgcacgcctgtagtcccagctactcgggaggctgaggcaggagaatggcttgaacctgcgaggcggaggttgcagtgagctaagatcatgccactggcactccagccttgagtgacagagcgaggctctgtatcaaaaaaaaaagttgcgggggggtgctcaatcttaactgcagaggatctacagatgaaaaaaaatgtggggaaatgctttaaaaaaatagcaaaatgtgcaacttcttacaaaaattgttaacgttaggtacttctatatattttatatgaccataatgtccgtgtgtgttttgtaccttcagtcccttgttattgttccgtatattacctgtaagcagatactgtattttattttagcctatttgacagaacacatcactcagaaaaagtgaagtttcagagcaaacagtgaagaaatcagtgtgattgtagacaaaaagtcggttcacagaacggagcagcggggagaggaagggaaaagcttcatagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtggcgggcgcctgtagtcccagctactcaggaggctgaggcaggaggatcacttgaacatgggaggcggaggttgcagtgagccaagatggcgccactgcactccagcctgggtgatggcgtgagactccatgtcaaaaaaaaaaacaaaggttggggggaggataggactggccaggcacggtggctcactcctgtaatctcagcactttgggaggcagaggtgggcggatcacttgaggtcaggagtttgagaccagcctggccaacgtggtgaaagcctgtctctactaaaaatacaaaaattagccgggcgtggtggtgggcgcctgtagtcccagctactcaggaggctgaggcaggagaatcacctaaatctgggaggcagaggttgcagtgagccgagattgcaccactgcactccagcctgggtaacagagactctgtctcaaaaaaagaaaaaaagaaagaaagaaagaaagaaaattggggataggagaacagcaaggtgggcatttcccggaattgtgtgcagatgcatccagtcgtggcattgcaagaagtctgtctgatgaagctcgggaagcattttgcaatattccctttggctgtgttcctgtgttccctgctcccacttttcttcccctggtttgtgattattaggagagaggttttgcaaagactcgttgctgtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctcta

SEQ ID NO: 71955 - DNA, 7146 bp, Homo sapiens
  misc_feature (2)..(2): n is a, c, g, or t
  misc_feature (8)..(8): n is a, c, g, or t
antctggntcggaggaatctcagtagggacaacaggcaggagaatatgggagcgcatttccccaggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggagggaaaaagaaatacagcctcaacagattaaaaaacaaaagtcacacttaaggatccttctagtcacatcagcagtgttctgcctttatgtagtagttgggcatataatccttccacacagcccctgcagggaaaggctaatcttacggataatccacgtgagatttccacacaagagaaaagcacacgcatagtgaaatgtcagtcttttcagtaatgaggatacctttaaggcactcttggactctcggcaaccacaacataatagttgaaagatcaagattggctccacgaaagtgatacggaggttaggatgctacttgctgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgtcaagggatatatttctatccctgccagcacagtgctggacatagtgagtactgaacacctaagaggcactcattcagactgacttctacaggacttctacgtgtgtgataaaagcctgtgaatcgtgagtccctgaaatatggtagcctggcccagcttctaaagaggaccttcgtagccacaaggcatgctaaacctctagggtctgatgctgtttttgttccaaatataaacgaaaggcactagtcagccgcctgcatagactttctaaacagtgagtaaataccatggaatgtcagaaatgactttatcatcgtcatcttgaagaaaaatatgaacactgatgaaggtcattttttttttttgacatctttctgtggcaaagctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaaaagcattaattgttcactggcaattactaaatgtattttgttgctctgagaaactcagcagtgtactgagatgtggctggctgtgccatcgtcatagtgcacagtgacttttctgtttcttatcactaaagactgaggtgaggttatgaaactttcattggtcccatcgttgtgcgcagggtgcaactggctacctagaagctgatggcaggagactgtttcacacacaggagattgtgagctgtgtaagtagtcatcgccactcaagtaggacaagggtcctacccaaggctaggaccgccctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacgaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatctcaaaaaaaaaaaaaagaaagaaagaaactgaaaagtgaggtgtggaactccaggcaacgacccaagcacttattttttaagagggaaaggactttggtcatgtttacattggcctttggtttttttttttctttcagccacaactatatgctgatataactcagccatcacttttgagttttgtttttaaatgaaggttaaatgtgacctgtgccctcacatttaattccgtttcatggagacatcttcctgactttgttggatagctgccactagggttgcttcgatcttcagccacatgctgtccttgaagcagctatttgaagatgtgttttctgaggaaaacaggctacaactgtttattaaaaccacttgcagtgcattcgtttatcagatgctcagtgcaaagtgtaattgggtcatggtcaaaaacgcttgcaacatctaattggcgttcaagatagtcattcaaaagttcttggcccgctgaagtctgttaacagttgaaacattctacagttaaccattagcatgctagttgtcctaatggaaatttttgaagagtttttcaatatataccctacccttgccaggaagagaagtaaaatcctcaggttgtggggtatttgtttctactccagcctggcaggcaaggctaaaacctgagattatcgatctatgagacatcttgatatgtaaagcacttaatattaaaggcataaaagtgaaactgctaaatatgtatagagaggttgacgtgtgatacgtgggacagttcacatagacatcagagaatttattccagaaaggagcctcctgaatgtgatgaatacggcaaagcctttaatcacatctcagcccttagcatcggaaagcttatactgtaaataaacttgatgaatattatatgtgaggaaaactttcatgtatagcactcattgcttcagacagaaaatgaattccgtcggtatgttccaatcgtgatgaatttgagaaacattgcaagagggagctcaatcttggccgggcgcagtggctcacgcctgtaatcgcagcactttgggaggccgaggcaggcggatcacgaggtcaggagtttgagaccagcctggccaacgtggtgaaagcctgtctctactaaaaatacaaaaattagccgggcgtggtggtgggcgcctgtagtcccagctactcaggaggctgaggcaggagaatcacctaaatctgggaggcagaggttgcagtgagccgagattgcaccactgcactccagcctgggtaacagagactctgtctcaaaaaaagaaaaaaagaaagaaagaaagaaagaaaattggggataggagaacagcaaggtgggcatttcccggaattgtgtgcagatgcatccagtcgtggcattgcaagaagtctgtctgatgaagctcgggaagcattttgcaatattccctttggctgtgttcctgtgttccctgctcccacttttcttcccctggtttgtgattattaggagagaggttttgcaaagactcgttgctgtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctcta

SEQ ID NO: 71956 - DNA, 9103 bp, Homo sapiens
tggcagtacagtgagactgtgttcaaaaaaacaaattacaagtatatcttacatagaagatgagatctacattatggatttctgccttgtgagagggcctaggaatgcacggtggttaaaaaaaacaaaaatctgctggctgggcgcggcggctcacgtctgtcatcccagcactttgggaggccgaggtcggctgatcacctgaggtcaggaattcaaaaacagccgggccaccacagcaaaaccctgtctctactacaaatacatggaggcggttgcctgggaggcagttctgctccgttcccatggattacaatttaggtgcctctgtcgggggaatatctctttcctagcagagatgaccaggcgaactgatcatccgtctaatcccaacccattgtcccggtaccacattcccgaaactaccaagcatccttctgttggctttctgtcttcttccatcctgtgtgattagtgtgattccaatacactgctttgtgtaattccacgaacttgcacctggactgtccttgtgatgaggattcccagcttccaaacttaatggtgattttctatgaagagctctgggtcctggatgtgtagtaagaacgaggaagttcaagaggcatcagccagataagacaaggtgacactgttggcagacatttccatttgtctctgctggatcttaacccctcaggacagtgctgcaaagaagccctcacgtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggagggaaaaagaaatacagcctcaacagattaaaaaacaaaagtcacacttaaggatccttctagtcacatcagcagtgttctgcctttatgtagtagttgggcatataatccttccacacagcccctgcagggaaaggctaatcttacggataatccacgtgagatttccacacaagagaaaagcacacgcatagtgaaatgtcagtcttttcagtaatgaggatacctttaaggcactcttggactctcggcaaccacaacataatagttgaaagatcaagattggctccacgaaagtgatacggaggttaggatgctacttgctgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgtcaagggatatatttctatccctgccagcacagtgctggacatagtgagtactgaacacctaagaggcactcattcagactgacttctacaggacttctacgtgtgtgataaaagcctgtgaatcgtgagtccctgaaatatggtagcctggcccagcttctaaagaggaccttcgtagccacaaggcatgctaaacctctagggtctgatgctgtttttgttccaaatataaacgaaaggcactagtcagccgcctgcatagactttctaaacagtgagtaaataccatggaatgtcagaaatgactttatcatcgtcatcttgaagaaaaatatgaacactgatgaaggtcattttttttttttgacatctttctgtggcaaagctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaaaagcattaattgttcactggcaattactaaatgtattttgttgctctgagaaactcagcagtgtactgagatgtggctggctgtgccatcgtcatagtgcacagtgacttttctgtttcttatcactaaagactgaggtgaggttatgaaactttcattggtcccatcgttgtgcgcagggtgcaactggctacctagaagctgatggcaggagactgtttcacacacaggagattgtgagctgtgtaagtagtcatcgccactcaagtaggacaagggtcctacccaaggctaggaccgccctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacgaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatctcaaaaaaaaaaaaaagaaagaaagaaactgaaaagtgaggtgtggaactccaggcaacgacccaagcacttattttttaagagggaaaggactttggtcatgtttacattggcctttggtttttttttttctttcagccacaactatatgctgatataactcagccatcacttttgagttttgtttttaaatgaaggttaaatgtgacctgtgccctcacatttaattccgtttcatggagacatcttcctgactttgttggatagctgccactagggttgcttcgatcttcagccacatgctgtccttgaagcagctatttgaagatgtgttttctgaggaaaacaggctacaactgtttattaaaaccacttgcagtgcattcgtttatcagatgctcagtgcaaagtgtaattgggtcatggtcaaaaacgcttgcaacatctaattggcgttcaagatagtcattcaaaagttcttggcccgctgaagtctgttaacagttgaaacattctacagttaaccattagcatgctagttgtcctaatggaaatttttgaagagtttttcaatatataccctacccttgccaggaagagaagtaaaatcctcaggttgtggggtatttgtttctactccagcctggcaggcaaggctaaaacctgagattatcgatctatgagacatcttgatatgtaaagcacttaatattaaaggcataaaagtgaaactgctaaatatgtatagagaggttgacgtgtgatacgtgggacagttcacatagacatcagagaatttattccagaaaggagcctcctgaatgtgatgaatacggcaaagcctttaatcacatctcagcccttagcatcggaaagcttatactgtaaataaacttgatgaatattatatgtgaggaaaactttcatgtatagcactcattgcttcagacagaaaatgaattccgtcggtatgttccaatcgtgatgaatttgagaaacattgcaagagggagctcaatcttggccgggcgcagtggctcacgcctgtaatcgcagcactttgggaggccgaggcaggcggatcacgaggtcagtagttcgagaccagcctggccaacatggtgaaaccttgtctctactaaaaatacaaaaaaaaattagctgggcacagtggcgcacgcctgtagtcccagctactcgggaggctgaggcaggagaatggcttgaacctgcgaggcggaggttgcagtgagctaagatcatgccactggcactccagccttgagtgacagagcgaggctctgtatcaaaaaaaaaagttgcgggggggtgctcaatcttaactgcagaggatctacagatgaaaaaaaatgtggggaaatgctttaaaaaaatagcaaaatgtgcaacttcttacaaaaattgttaacgttaggtacttctatatattttatatgaccataatgtccgtgtgtgttttgtaccttcagtcccttgttattgttccgtatattacctgtaagcagatactgtattttattttagcctatttgacagaacacatcactcagaaaaagtgaagtttcagagcaaacagtgaagaaatcagtgtgattgtagacaaaaagtcggttcacagaacggagcagcggggagaggaagggaaaagcttcatagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtggcgggcgcctgtagtcccagctactcaggaggctgaggcaggaggatcacttgaacatgggaggcggaggttgcagtgagccaagatggcgccactgcactccagcctgggtgatggcgtgagactccatgtcaaaaaaaaaaacaaaggttggggggaggataggactggccaggcacggtggctcactcctgtaatctcagcactttgggaggcagaggtgggcggatcacttgaggtcaggagtttgagaccagcctggccaacgtggtgaaagcctgtctctactaaaaatacaaaaattagccgggcgtggtggtgggcgcctgtagtcccagctactcaggaggctgaggcaggagaatcacctaaatctgggaggcagaggttgcagtgagccgagattgcaccactgcactccagcctgggtaacagagactctgtctcaaaaaaagaaaaaaagaaagaaagaaagaaagaaaattggggataggagaacagcaaggtgggcatttcccggaattgtgtgcagatgcatccagtcgtggcattgcaagaagtctgtctgatgaagctcgggaagcattttgcaatattccctttggctgtgttcctgtgttccctgctcccacttttcttcccctggtttgtgattattaggagagaggttttgcaaagactcgttgctgtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctcta

SEQ ID NO: 71957 - DNA, 8665 bp, Homo sapiens
  misc_feature (2)..(2): n is a, c, g, or t
  misc_feature (8)..(8): n is a, c, g, or t
antctggntcggaggaatctcagtagggacaacaggcaggagaatatgggagcgcatttccccaggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggagggaaaaagaaatacagcctcaacagattaaaaaacaaaagtcacacttaaggatccttctagtcacatcagcagtgttctgcctttatgtagtagttgggcatataatccttccacacagcccctgcagggaaaggctaatcttacggataatccacgtgagatttccacacaagagaaaagcacacgcatagtgaaatgtcagtcttttcagtaatgaggatacctttaaggcactcttggactctcggcaaccacaacataatagttgaaagatcaagattggctccacgaaagtgatacggaggttaggatgctacttgctgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgtcaagggatatatttctatccctgccagcacagtgctggacatagtgagtactgaacacctaagaggcactcattcagactgacttctacaggacttctacgtgtgtgataaaagcctgtgaatcgtgagtccctgaaatatggtagcctggcccagcttctaaagaggaccttcgtagccacaaggcatgctaaacctctagggtctgatgctgtttttgttccaaatataaacgaaaggcactagtcagccgcctgcatagactttctaaacagtgagtaaataccatggaatgtcagaaatgactttatcatcgtcatcttgaagaaaaatatgaacactgatgaaggtcattttttttttttgacatctttctgtggcaaagctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaaaagcattaattgttcactggcaattactaaatgtattttgttgctctgagaaactcagcagtgtactgagatgtggctggctgtgccatcgtcatagtgcacagtgacttttctgtttcttatcactaaagactgaggtgaggttatgaaactttcattggtcccatcgttgtgcgcagggtgcaactggctacctagaagctgatggcaggagactgtttcacacacaggagattgtgagctgtgtaagtagtcatcgccactcaagtaggacaagggtcctacccaaggctaggaccgccctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacgaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatctcaaaaaaaaaaaaaagaaagaaagaaactgaaaagtgaggtgtggaactccaggcaacgacccaagcacttattttttaagagggaaaggactttggtcatgtttacattggcctttggtttttttttttctttcagccacaactatatgctgatataactcagccatcacttttgagttttgtttttaaatgaaggttaaatgtgacctgtgccctcacatttaattccgtttcatggagacatcttcctgactttgttggatagctgccactagggttgcttcgatcttcagccacatgctgtccttgaagcagctatttgaagatgtgttttctgaggaaaacaggctacaactgtttattaaaaccacttgcagtgcattcgtttatcagatgctcagtgcaaagtgtaattgggtcatggtcaaaaacgcttgcaacatctaattggcgttcaagatagtcattcaaaagttcttggcccgctgaagtctgttaacagttgaaacattctacagttaaccattagcatgctagttgtcctaatggaaatttttgaagagtttttcaatatataccctacccttgccaggaagagaagtaaaatcctcaggttgtggggtatttgtttctactccagcctggcaggcaaggctaaaacctgagattatcgatctatgagacatcttgatatgtaaagcacttaatattaaaggcataaaagtgaaactgctaaatatgtatagagaggttgacgtgtgatacgtgggacagttcacatagacatcagagaatttattccagaaaggagcctcctgaatgtgatgaatacggcaaagcctttaatcacatctcagcccttagcatcggaaagcttatactgtaaataaacttgatgaatattatatgtgaggaaaactttcatgtatagcactcattgcttcagacagaaaatgaattccgtcggtatgttccaatcgtgatgaatttgagaaacattgcaagagggagctcaatcttggccgggcgcagtggctcacgcctgtaatcgcagcactttgggaggccgaggcaggcggatcacgaggtcagtagttcgagaccagcctggccaacatggtgaaaccttgtctctactaaaaatacaaaaaaaaattagctgggcacagtggcgcacgcctgtagtcccagctactcgggaggctgaggcaggagaatggcttgaacctgcgaggcggaggttgcagtgagctaagatcatgccactggcactccagccttgagtgacagagcgaggctctgtatcaaaaaaaaaagttgcgggggggtgctcaatcttaactgcagaggatctacagatgaaaaaaaatgtggggaaatgctttaaaaaaatagcaaaatgtgcaacttcttacaaaaattgttaacgttaggtacttctatatattttatatgaccataatgtccgtgtgtgttttgtaccttcagtcccttgttattgttccgtatattacctgtaagcagatactgtattttattttagcctatttgacagaacacatcactcagaaaaagtgaagtttcagagcaaacagtgaagaaatcagtgtgattgtagacaaaaagtcggttcacagaacggagcagcggggagaggaagggaaaagcttcatagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtggcgggcgcctgtagtcccagctactcaggaggctgaggcaggaggatcacttgaacatgggaggcggaggttgcagtgagccaagatggcgccactgcactccagcctgggtgatggcgtgagactccatgtcaaaaaaaaaaacaaaggttggggggaggataggactggccaggcacggtggctcactcctgtaatctcagcactttgggaggcagaggtgggcggatcacttgaggtcaggagtttgagaccagcctggccaacgtggtgaaagcctgtctctactaaaaatacaaaaattagccgggcgtggtggtgggcgcctgtagtcccagctactcaggaggctgaggcaggagaatcacctaaatctgggaggcagaggttgcagtgagccgagattgcaccactgcactccagcctgggtaacagagactctgtctcaaaaaaagaaaaaaagaaagaaagaaagaaagaaaattggggataggagaacagcaaggtgggcatttcccggaattgtgtgcagatgcatccagtcgtggcattgcaagaagtctgtctgatgaagctcgggaagcattttgcaatattccctttggctgtgttcctgtgttccctgctcccacttttcttcccctggtttgtgattattaggagagaggttttgcaaagactcgttgctgtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctctaaaaaaagaaacaatatagaagaaactttttgcagataaaacaatatactaagtaatagcaattaacaaacgacaaaaagagaaaagaataaataacaaacaaaaaaggggggggatatatatacggggggaaattccaccctttagaaaaggccagtgtttaataaagggcggggagggaagaagttgtgttgaagcactctgtggtagacccaaagggatt

SEQ ID NO: 71958 - DNA, 8459 bp, Homo sapiens
  misc_feature (2)..(2): n is a, c, g, or t
  misc_feature (8)..(8): n is a, c, g, or t
antctggntcggaggaatctcagtagggacaacaggcaggagaatatgggagcgcatttccccaggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggagggaaaaagaaatacagcctcaacagattaaaaaacaaaagtcacacttaaggatccttctagtcacatcagcagtgttctgcctttatgtagtagttgggcatataatccttccacacagcccctgcagggaaaggctaatcttacggataatccacgtgagatttccacacaagagaaaagcacacgcatagtgaaatgtcagtcttttcagtaatgaggatacctttaaggcactcttggactctcggcaaccacaacataatagttgaaagatcaagattggctccacgaaagtgatacggaggttaggatgctacttgctgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgtcaagggatatatttctatccctgccagcacagtgctggacatagtgagtactgaacacctaagaggcactcattcagactgacttctacaggacttctacgtgtgtgataaaagcctgtgaatcgtgagtccctgaaatatggtagcctggcccagcttctaaagaggaccttcgtagccacaaggcatgctaaacctctagggtctgatgctgtttttgttccaaatataaacgaaaggcactagtcagccgcctgcatagactttctaaacagtgagtaaataccatggaatgtcagaaatgactttatcatcgtcatcttgaagaaaaatatgaacactgatgaaggtcattttttttttttgacatctttctgtggcaaagctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaaaagcattaattgttcactggcaattactaaatgtattttgttgctctgagaaactcagcagtgtactgagatgtggctggctgtgccatcgtcatagtgcacagtgacttttctgtttcttatcactaaagactgaggtgaggttatgaaactttcattggtcccatcgttgtgcgcagggtgcaactggctacctagaagctgatggcaggagactgtttcacacacaggagattgtgagctgtgtaagtagtcatcgccactcaagtaggacaagggtcctacccaaggctaggaccgccctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacgaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatctcaaaaaaaaaaaaaagaaagaaagaaactgaaaagtgaggtgtggaactccaggcaacgacccaagcacttattttttaagagggaaaggactttggtcatgtttacattggcctttggtttttttttttctttcagccacaactatatgctgatataactcagccatcacttttgagttttgtttttaaatgaaggttaaatgtgacctgtgccctcacatttaattccgtttcatggagacatcttcctgactttgttggatagctgccactagggttgcttcgatcttcagccacatgctgtccttgaagcagctatttgaagatgtgttttctgaggaaaacaggctacaactgtttattaaaaccacttgcagtgcattcgtttatcagatgctcagtgcaaagtgtaattgggtcatggtcaaaaacgcttgcaacatctaattggcgttcaagatagtcattcaaaagttcttggcccgctgaagtctgttaacagttgaaacattctacagttaaccattagcatgctagttgtcctaatggaaatttttgaagagtttttcaatatataccctacccttgccaggaagagaagtaaaatcctcaggttgtggggtatttgtttctactccagcctggcaggcaaggctaaaacctgagattatcgatctatgagacatcttgatatgtaaagcacttaatattaaaggcataaaagtgaaactgctaaatatgtatagagaggttgacgtgtgatacgtgggacagttcacatagacatcagagaatttattccagaaaggagcctcctgaatgtgatgaatacggcaaagcctttaatcacatctcagcccttagcatcggaaagcttatactgtaaataaacttgatgaatattatatgtgaggaaaactttcatgtatagcactcattgcttcagacagaaaatgaattccgtcggtatgttccaatcgtgatgaatttgagaaacattgcaagagggagctcaatcttggccgggcgcagtggctcacgcctgtaatcgcagcactttgggaggccgaggcaggcggatcacgaggtcagtagttcgagaccagcctggccaacatggtgaaaccttgtctctactaaaaatacaaaaaaaaattagctgggcacagtggcgcacgcctgtagtcccagctactcgggaggctgaggcaggagaatggcttgaacctgcgaggcggaggttgcagtgagctaagatcatgccactggcactccagccttgagtgacagagcgaggctctgtatcaaaaaaaaaagttgcgggggggtgctcaatcttaactgcagaggatctacagatgaaaaaaaatgtggggaaatgctttaaaaaaatagcaaaatgtgcaacttcttacaaaaattgttaacgttaggtacttctatatattttatatgaccataatgtccgtgtgtgttttgtaccttcagtcccttgttattgttccgtatattacctgtaagcagatactgtattttattttagcctatttgacagaacacatcactcagaaaaagtgaagtttcagagcaaacagtgaagaaatcagtgtgattgtagacaaaaagtcggttcacagaacggagcagcggggagaggaagggaaaagcttcatagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtggcgggcgcctgtagtcccagctactcaggaggctgaggcaggaggatcacttgaacatgggaggcggaggttgcagtgagccaagatggcgccactgcactccagcctgggtgatggcgtgagactccatgtcaaaaaaaaaaacaaaggttggggggaggataggactggccaggcacggtggctcactcctgtaatctcagcactttgggaggcagaggtgggcggatcacttgaggtcaggagtttgagaccagcctggccaacgtggtgaaagcctgtctctactaaaaatacaaaaattagccgggcgtggtggtgggcgcctgtagtcccagctactcaggaggctgaggcaggagaatcacctaaatctgggaggcagaggttgcagtgagccgagattgcaccactgcactccagcctgggtaacagagactctgtctcaaaaaaagaaaaaaagaaagaaagaaagaaagaaaattggggataggagaacagcaaggtgggcatttcccggaattgtgtgcagatgcatccagtcgtggcattgcaagaagtctgtctgatgaagctcgggaagcattttgcaatattccctttggctgtgttcctgtgttccctgctcccacttttcttcccctggtttgtgattattaggagagaggttttgcaaagactcgttgctgtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttaaggggggtggtttttaaaactttggtaaaccattaatattcatttttaggtgaaaacaaaaggc

SEQ ID NO: 71959 - DNA, 9049 bp, Homo sapiens
tggcagtacagtgagactgtgttcaaaaaaacaaattacaagtatatcttacatagaagatgagatctacattatggatttctgccttgtgagagggcctaggaatgcacggtggttaaaaaaaacaaaaatctgctggctgggcgcggcggctcacgtctgtcatcccagcactttgggaggccgaggtcggctgatcacctgaggtcaggaattcaaaaacagccgggccaccacagcaaaaccctgtctctactacaaatacatggaggcggttgcctgggaggcagttctgctccgttcccatggattacaatttaggtgcctctgtcgggggaatatctctttcctagcagagatgaccaggcgaactgatcatccgtctaatcccaacccattgtcccggtaccacattcccgaaactaccaagcatccttctgttggctttctgtcttcttccatcctgtgtgattagtgtgattccaatacactgctttgtgtaattccacgaacttgcacctggactgtccttgtgatgaggattcccagcttccaaacttaatggtgattttctatgaagagctctgggtcctggatgtgtagtaagaacgaggaagttcaagaggcatcagccagataagacaaggtgacactgttggcagacatttccatttgtctctgctggatcttaacccctcaggacagtgctgcaaagaagccctcacgtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggagggaaaaagaaatacagcctcaacagattaaaaaacaaaagtcacacttaaggatccttctagtcacatcagcagtgttctgcctttatgtagtagttgggcatataatccttccacacagcccctgcagggaaaggctaatcttacggataatccacgtgagatttccacacaagagaaaagcacacgcatagtgaaatgtcagtcttttcagtaatgaggatacctttaaggcactcttggactctcggcaaccacaacataatagttgaaagatcaagattggctccacgaaagtgatacggaggttaggatgctacttgctgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgtcaagggatatatttctatccctgccagcacagtgctggacatagtgagtactgaacacctaagaggcactcattcagactgacttctacaggacttctacgtgtgtgataaaagaccttcgtagccacaaggcatgctaaacctctagggtctgatgctgtttttgttccaaatataaacgaaaggcactagtcagccgcctgcatagactttctaaacagtgagtaaataccatggaatgtcagaaatgactttatcatcgtcatcttgaagaaaaatatgaacactgatgaaggtcattttttttttttgacatctttctgtggcaaagctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaaaagcattaattgttcactggcaattactaaatgtattttgttgctctgagaaactcagcagtgtactgagatgtggctggctgtgccatcgtcatagtgcacagtgacttttctgtttcttatcactaaagactgaggtgaggttatgaaactttcattggtcccatcgttgtgcgcagggtgcaactggctacctagaagctgatggcaggagactgtttcacacacaggagattgtgagctgtgtaagtagtcatcgccactcaagtaggacaagggtcctacccaaggctaggaccgccctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacgaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatctcaaaaaaaaaaaaaagaaagaaagaaactgaaaagtgaggtgtggaactccaggcaacgacccaagcacttattttttaagagggaaaggactttggtcatgtttacattggcctttggtttttttttttctttcagccacaactatatgctgatataactcagccatcacttttgagttttgtttttaaatgaaggttaaatgtgacctgtgccctcacatttaattccgtttcatggagacatcttcctgactttgttggatagctgccactagggttgcttcgatcttcagccacatgctgtccttgaagcagctatttgaagatgtgttttctgaggaaaacaggctacaactgtttattaaaaccacttgcagtgcattcgtttatcagatgctcagtgcaaagtgtaattgggtcatggtcaaaaacgcttgcaacatctaattggcgttcaagatagtcattcaaaagttcttggcccgctgaagtctgttaacagttgaaacattctacagttaaccattagcatgctagttgtcctaatggaaatttttgaagagtttttcaatatataccctacccttgccaggaagagaagtaaaatcctcaggttgtggggtatttgtttctactccagcctggcaggcaaggctaaaacctgagattatcgatctatgagacatcttgatatgtaaagcacttaatattaaaggcataaaagtgaaactgctaaatatgtatagagaggttgacgtgtgatacgtgggacagttcacatagacatcagagaatttattccagaaaggagcctcctgaatgtgatgaatacggcaaagcctttaatcacatctcagcccttagcatcggaaagcttatactgtaaataaacttgatgaatattatatgtgaggaaaactttcatgtatagcactcattgcttcagacagaaaatgaattccgtcggtatgttccaatcgtgatgaatttgagaaacattgcaagagggagctcaatcttggccgggcgcagtggctcacgcctgtaatcgcagcactttgggaggccgaggcaggcggatcacgaggtcagtagttcgagaccagcctggccaacatggtgaaaccttgtctctactaaaaatacaaaaaaaaattagctgggcacagtggcgcacgcctgtagtcccagctactcgggaggctgaggcaggagaatggcttgaacctgcgaggcggaggttgcagtgagctaagatcatgccactggcactccagccttgagtgacagagcgaggctctgtatcaaaaaaaaaagttgcgggggggtgctcaatcttaactgcagaggatctacagatgaaaaaaaatgtggggaaatgctttaaaaaaatagcaaaatgtgcaacttcttacaaaaattgttaacgttaggtacttctatatattttatatgaccataatgtccgtgtgtgttttgtaccttcagtcccttgttattgttccgtatattacctgtaagcagatactgtattttattttagcctatttgacagaacacatcactcagaaaaagtgaagtttcagagcaaacagtgaagaaatcagtgtgattgtagacaaaaagtcggttcacagaacggagcagcggggagaggaagggaaaagcttcatagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtggcgggcgcctgtagtcccagctactcaggaggctgaggcaggaggatcacttgaacatgggaggcggaggttgcagtgagccaagatggcgccactgcactccagcctgggtgatggcgtgagactccatgtcaaaaaaaaaaacaaaggttggggggaggataggactggccaggcacggtggctcactcctgtaatctcagcactttgggaggcagaggtgggcggatcacttgaggtcaggagtttgagaccagcctggccaacgtggtgaaagcctgtctctactaaaaatacaaaaattagccgggcgtggtggtgggcgcctgtagtcccagctactcaggaggctgaggcaggagaatcacctaaatctgggaggcagaggttgcagtgagccgagattgcaccactgcactccagcctgggtaacagagactctgtctcaaaaaaagaaaaaaagaaagaaagaaagaaagaaaattggggataggagaacagcaaggtgggcatttcccggaattgtgtgcagatgcatccagtcgtggcattgcaagaagtctgtctgatgaagctcgggaagcattttgcaatattccctttggctgtgttcctgtgttccctgctcccacttttcttcccctggtttgtgattattaggagagaggttttgcaaagactcgttgctgtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctcta

SEQ ID NO: 71960 - DNA, 7260 bp, Homo sapiens
  misc_feature (2)..(2): n is a, c, g, or t
  misc_feature (8)..(8): n is a, c, g, or t
antctggntcggaggaatctcagtagggacaacaggcaggagaatatgggagcgcatttccccaggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggagggaaaaagaaatacagcctcaacagattaaaaaacaaaagtcacacttaaggatccttctagtcacatcagcagtgttctgcctttatgtagtagttgggcatataatccttccacacagcccctgcagggaaaggctaatcttacggataatccacgtgagatttccacacaagagaaaagcacacgcatagtgaaatgtcagtcttttcagtaatgaggatacctttaaggcactcttggactctcggcaaccacaacataatagttgaaagatcaagattggctccacgaaagtgatacggaggttaggatgctacttgctgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgtcaagggatatatttctatccctgccagcacagtgctggacatagtgagtactgaacacctaagaggcactcattcagactgacttctacaggacttctacgtgtgtgataaaagcctgtgaatcgtgagtccctgaaatatggtagcctggcccagcttctaaagaggaccttcgtagccacaaggcatgctaaacctctagggtctgatgctgtttttgttccaaatataaacgaaaggcactagtcagccgcctgcatagactttctaaacagtgagtaaataccatggaatgtcagaaatgactttatcatcgtcatcttgaagaaaaatatgaacactgatgaaggtcattttttttttttgacatctttctgtggcaaagctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaaaagcattaattgttcactggcaattactaaatgtattttgttgctctgagaaactcagcagtgtactgagatgtggctggctgtgccatcgtcatagtgcacagtgacttttctgtttcttatcactaaagactgaggtgaggttatgaaactttcattggtcccatcgttgtgcgcagggtgcaactggctacctagaagctgatggcaggagactgtttcacacacaggagattgtgagctgtgtaagtagtcatcgccactcaagtaggacaagggtcctacccaaggctaggaccgccctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacgaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatctcaaaaaaaaaaaaaagaaagaaagaaactgaaaagtgaggtgtggaactccaggcaacgacccaagcacttattttttaagagggaaaggactttggtcatgtttacattggcctttggtttttttttttctttcagccacaactatatgctgatataactcagccatcacttttgagttttgtttttaaatgaaggttaaatgtgacctgtgccctcacatttaattccgtttcatggagacatcttcctgactttgttggatagctgccactagggttgcttcgatcttcagccacatgctgtccttgaagcagctatttgaagatgtgttttctgaggaaaacaggctacaactgtttattaaaaccacttgcagtgcattcgtttatcagatgctcagtgcaaagtgtaattgggtcatggtcaaaaacgcttgcaacatctaattggcgttcaagatagtcattcaaaagttcttggcccgctgaagtctgttaacagttgaaacattctacagttaaccattagcatgctagttgtcctaatggaaatttttgaagagtttttcaatatataccctacccttgccaggaagagaagtaaaatcctcaggttgtggggtatttgtttctactccagcctggcaggcaaggctaaaacctgagattatcgatctatgagacatcttgatatgtaaagcacttaatattaaaggcataaaagtgaaactgctaaatatgtatagagaggttgacgtgtgatacgtgggacagttcacatagacatcagagaatttattccagaaaggagcctcctgaatgtgatgaatacggcaaagcctttaatcacatctcagcccttagcatcggaaagcttatactgtaaataaacttgatgaatattatatgtgaggaaaactttcatgtatagcactcattgcttcagacagaaaatgaattccgtcggtatgttccaatcgtgatgaatttgagaaacattgcaagagggagctcaatcttggccgggcgcagtggctcacgcctgtaatcgcagcactttgggaggccgaggcaggcggatcacgaggtcagtagttcgagaccagcctggccaacatggtgaaaccttgtctctactaaaaatacaaaaaaaaattagctgggcacagtggcgcacgcctgtagtcccagctactcgggaggctgaggcaggagaatggcttgaacctgcgaggcggaggttgcagtgagctaagatcatgccactggcactccagccttgagtgacagagcgaggctctgtatcaaaaaaaaaagttgcgggggggtgctcaatcttaactgcagaggatctacagatgaaaaaaaatgtggggaaatgctttaaaaaaatagcaaaatgtgcaacttcttacaaaaattgttaacgttaggtacttctatatattttatatgaccataatgtccgtgtgtgttttgtaccttcagtcccttgttattgttccgtatattacctgtaagcagatactgtattttattttagcctatttgacagaacacatcactcagaaaaagtgaagtttcagagcaaacagtgaagaaatcagtgtgattgtagacaaaaagtcggttcacagaacggagcagcggggagaggaagggaaaagcttcatagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtggcgggcgcctgtagtcccagctactcaggaggctgaggcaggaggatcacttgaacatgggaggcggaggttgcagtgagccaagatggcgccactgcactccagcctgggtgatggcgtgagactccatgtcaaaaaaaaaaacaaaggttggggggaggataggactggccaggcacggtggctcactcctgtaatctcagcactttgggaggcagaggtgggcggatcacttgaggtcaggagtttgagaccagcctggccaacgtggtgaaagcctgtctctactaaaaatacaaaaattagccgggcgtggtggtgggcgcctgtagtcccagctactcaggaggctgaggcaggagaatcacctaaatctgggaggcagaggttgcagtgagccgagattgcaccactgcactccagcctgggtaacagagactctgtctcaaaaaaagaaaaaaagaaagaaagaaagaaagaaaattggggataggagaacagcaaggtgggcatttcccggaattgtgtgcagatgcatccagtcgtggcattgcaagaagtctgtctgatgaagctcgggaagcattttgcaatattccctttggctgtgttcctgtgttccctgctcccacttttcttcccctggtttgtgattattaggagagaggttttgcaaagactcgttgctgtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagacctgggatattagctttggggtttgagagcatcatggggcagaagcagaagcg

SEQ ID NO: 71961 - DNA, 9049 bp, Homo sapiens
tggcagtacagtgagactgtgttcaaaaaaacaaattacaagtatatcttacatagaagatgagatctacattatggatttctgccttgtgagagggcctaggaatgcacggtggttaaaaaaaacaaaaatctgctggctgggcgcggcggctcacgtctgtcatcccagcactttgggaggccgaggtcggctgatcacctgaggtcaggaattcaaaaacagccgggccaccacagcaaaaccctgtctctactacaaatacatggaggcggttgcctgggaggcagttctgctccgttcccatggattacaatttaggtgcctctgtcgggggaatatctctttcctagcagagatgaccaggcgaactgatcatccgtctaatcccaacccattgtcccggtaccacattcccgaaactaccaagcatccttctgttggctttctgtcttcttccatcctgtgtgattagtgtgattccaatacactgctttgtgtaattccacgaacttgcacctggactgtccttgtgatgaggattcccagcttccaaacttaatggtgattttctatgaagagctctgggtcctggatgtgtagtaagaacgaggaagttcaagaggcatcagccagataagacaaggtgacactgttggcagacatttccatttgtctctgctggatcttaacccctcaggacagtgctgcaaagaagccctcacgtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggagggaaaaagaaatacagcctcaacagattaaaaaacaaaagtcacacttaaggatccttctagtcacatcagcagtgttctgcctttatgtagtagttgggcatataatccttccacacagcccctgcagggaaaggctaatcttacggataatccacgtgagatttccacacaagagaaaagcacacgcatagtgaaatgtcagtcttttcagtaatgaggatacctttaaggcactcttggactctcggcaaccacaacataatagttgaaagatcaagattggctccacgaaagtgatacggaggttaggatgctacttgctgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgtcaagggatatatttctatccctgccagcacagtgctggacatagtgagtactgaacacctaagaggcactcattcagactgacttctacaggacttctacgtgtgtgataaaagcctgtgaatcgtgagtccctgaaatatggtagcctggcccagcttctaaagaggaccttcgtagccacaaggcatgctaaacctctagggtctgatgctgtttttgttccaaatataaacgaaaggcactagtcagccgcctgcatagactttctaaacagtgagtaaataccatggaatgtcagaaatgactttatcatcgtcatcttgaagaaaaatatgaacactgatgaaggtcattttttttttttgacatctttctgtggcaaagctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaatcagcagtgtactgagatgtggctggctgtgccatcgtcatagtgcacagtgacttttctgtttcttatcactaaagactgaggtgaggttatgaaactttcattggtcccatcgttgtgcgcagggtgcaactggctacctagaagctgatggcaggagactgtttcacacacaggagattgtgagctgtgtaagtagtcatcgccactcaagtaggacaagggtcctacccaaggctaggaccgccctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacgaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatctcaaaaaaaaaaaaaagaaagaaagaaactgaaaagtgaggtgtggaactccaggcaacgacccaagcacttattttttaagagggaaaggactttggtcatgtttacattggcctttggtttttttttttctttcagccacaactatatgctgatataactcagccatcacttttgagttttgtttttaaatgaaggttaaatgtgacctgtgccctcacatttaattccgtttcatggagacatcttcctgactttgttggatagctgccactagggttgcttcgatcttcagccacatgctgtccttgaagcagctatttgaagatgtgttttctgaggaaaacaggctacaactgtttattaaaaccacttgcagtgcattcgtttatcagatgctcagtgcaaagtgtaattgggtcatggtcaaaaacgcttgcaacatctaattggcgttcaagatagtcattcaaaagttcttggcccgctgaagtctgttaacagttgaaacattctacagttaaccattagcatgctagttgtcctaatggaaatttttgaagagtttttcaatatataccctacccttgccaggaagagaagtaaaatcctcaggttgtggggtatttgtttctactccagcctggcaggcaaggctaaaacctgagattatcgatctatgagacatcttgatatgtaaagcacttaatattaaaggcataaaagtgaaactgctaaatatgtatagagaggttgacgtgtgatacgtgggacagttcacatagacatcagagaatttattccagaaaggagcctcctgaatgtgatgaatacggcaaagcctttaatcacatctcagcccttagcatcggaaagcttatactgtaaataaacttgatgaatattatatgtgaggaaaactttcatgtatagcactcattgcttcagacagaaaatgaattccgtcggtatgttccaatcgtgatgaatttgagaaacattgcaagagggagctcaatcttggccgggcgcagtggctcacgcctgtaatcgcagcactttgggaggccgaggcaggcggatcacgaggtcagtagttcgagaccagcctggccaacatggtgaaaccttgtctctactaaaaatacaaaaaaaaattagctgggcacagtggcgcacgcctgtagtcccagctactcgggaggctgaggcaggagaatggcttgaacctgcgaggcggaggttgcagtgagctaagatcatgccactggcactccagccttgagtgacagagcgaggctctgtatcaaaaaaaaaagttgcgggggggtgctcaatcttaactgcagaggatctacagatgaaaaaaaatgtggggaaatgctttaaaaaaatagcaaaatgtgcaacttcttacaaaaattgttaacgttaggtacttctatatattttatatgaccataatgtccgtgtgtgttttgtaccttcagtcccttgttattgttccgtatattacctgtaagcagatactgtattttattttagcctatttgacagaacacatcactcagaaaaagtgaagtttcagagcaaacagtgaagaaatcagtgtgattgtagacaaaaagtcggttcacagaacggagcagcggggagaggaagggaaaagcttcatagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtggcgggcgcctgtagtcccagctactcaggaggctgaggcaggaggatcacttgaacatgggaggcggaggttgcagtgagccaagatggcgccactgcactccagcctgggtgatggcgtgagactccatgtcaaaaaaaaaaacaaaggttggggggaggataggactggccaggcacggtggctcactcctgtaatctcagcactttgggaggcagaggtgggcggatcacttgaggtcaggagtttgagaccagcctggccaacgtggtgaaagcctgtctctactaaaaatacaaaaattagccgggcgtggtggtgggcgcctgtagtcccagctactcaggaggctgaggcaggagaatcacctaaatctgggaggcagaggttgcagtgagccgagattgcaccactgcactccagcctgggtaacagagactctgtctcaaaaaaagaaaaaaagaaagaaagaaagaaagaaaattggggataggagaacagcaaggtgggcatttcccggaattgtgtgcagatgcatccagtcgtggcattgcaagaagtctgtctgatgaagctcgggaagcattttgcaatattccctttggctgtgttcctgtgttccctgctcccacttttcttcccctggtttgtgattattaggagagaggttttgcaaagactcgttgctgtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctcta

SEQ ID NO: 71962 - DNA, 7261 bp, Homo sapiens
  misc_feature (12)..(12): n is a, c, g, or t
  misc_feature (24)..(24): n is a, c, g, or t
  misc_feature (47)..(47): n is a, c, g, or t
  misc_feature (61)..(61): n is a, c, g, or t
gggttttaaaancgccgcccaggnccaaagttggcaagccttgcagntcgacttttaaagnttccccggtcaaggttacggcactcttggactctcggcaaccacaacataatagttgaaagatcaagattggctccacgaaagtgatacggaggttaggatgctacttgctgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgtcaagggatatatttctatccctgccagcacagtgctggacatagtgagtactgaacacctaagaggcactcattcagactgacttctacaggacttctacgtgtgtgataaaagcctgtgaatcgtgagtccctgaaatatggtagcctggcccagcttctaaagaggaccttcgtagccacaaggcatgctaaacctctagggtctgatgctgtttttgttccaaatataaacgaaaggcactagtcagccgcctgcatagactttctaaacagtgagtaaataccatggaatgtcagaaatgactttatcatcgtcatcttgaagaaaaatatgaacactgatgaaggtcattttttttttttgacatctttctgtggcaaagctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaaaagcattaattgttcactggcaattactaaatgtattttgttgctctgagaaactcagcagtgtactgagatgtggctggctgtgccatcgtcatagtgcacagtgacttttctgtttcttatcactaaagactgaggtgaggttatgaaactttcattggtcccatcgttgtgcgcagggtgcaactggctacctagaagctgatggcaggagactgtttcacacacaggagattgtgagctgtgtaagtagtcatcgccactcaagtaggacaagggtcctacccaaggctaggaccgccctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacgaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatctcaaaaaaaaaaaaaagaaagaaagaaactgaaaagtgaggtgtggaactccaggcaacgacccaagcacttattttttaagagggaaaggactttggtcatgtttacattggcctttggtttttttttttctttcagccacaactatatgctgatataactcagccatcacttttgagttttgtttttaaatgaaggttaaatgtgacctgtgccctcacatttaattccgtttcatggagacatcttcctgactttgttggatagctgccactagggttgcttcgatcttcagccacatgctgtccttgaagcagctatttgaagatgtgttttctgaggaaaacaggctacaactgtttattaaaaccacttgcagtgcattcgtttatcagatgctcagtgcaaagtgtaattgggtcatggtcaaaaacgcttgcaacatctaattggcgttcaagatagtcattcaaaagttcttggcccgctgaagtctgttaacagttgaaacattctacagttaaccattagcatgctagttgtcctaatggaaatttttgaagagtttttcaatatataccctacccttgccaggaagagaagtaaaatcctcaggttgtggggtatttgtttctactccagcctggcaggcaaggctaaaacctgagattatcgatctatgagacatcttgatatgtaaagcacttaatattaaaggcataaaagtgaaactgctaaatatgtatagagaggttgacgtgtgatacgtgggacagttcacatagacatcagagaatttattccagaaaggagcctcctgaatgtgatgaatacggcaaagcctttaatcacatctcagcccttagcatcggaaagcttatactgtaaataaacttgatgaatattatatgtgaggaaaactttcatgtatagcactcattgcttcagacagaaaatgaattccgtcggtatgttccaatcgtgatgaatttgagaaacattgcaagagggagctcaatcttggccgggcgcagtggctcacgcctgtaatcgcagcactttgggaggccgaggcaggcggatcacgaggtcagtagttcgagaccagcctggccaacatggtgaaaccttgtctctactaaaaatacaaaaaaaaattagctgggcacagtggcgcacgcctgtagtcccagctactcgggaggctgaggcaggagaatggcttgaacctgcgaggcggaggttgcagtgagctaagatcatgccactggcactccagccttgagtgacagagcgaggctctgtatcaaaaaaaaaagttgcgggggggtgctcaatcttaactgcagaggatctacagatgaaaaaaaatgtggggaaatgctttaaaaaaatagcaaaatgtgcaacttcttacaaaaattgttaacgttaggtacttctatatattttatatgaccataatgtccgtgtgtgttttgtaccttcagtcccttgttattgttccgtatattacctgtaagcagatactgtattttattttagcctatttgacagaacacatcactcagaaaaagtgaagtttcagagcaaacagtgaagaaatcagtgtgattgtagacaaaaagtcggttcacagaacggagcagcggggagaggaagggaaaagcttcatagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtggcgggcgcctgtagtcccagctactcaggaggctgaggcaggaggatcacttgaacatgggaggcggaggttgcagtgagccaagatggcgccactgcactccagcctgggtgatggcgtgagactccatgtcaaaaaaaaaaacaaaggttggggggaggataggactggccaggcacggtggctcactcctgtaatctcagcactttgggaggcagaggtgggcggatcacttgaggtcaggagtttgagaccagcctggccaacgtggtgaaagcctgtctctactaaaaatacaaaaattagccgggcgtggtggtgggcgcctgtagtcccagctactcaggaggctgaggcaggagaatcacctaaatctgggaggcagaggttgcagtgagccgagattgcaccactgcactccagcctgggtaacagagactctgtctcaaaaaaagaaaaaaagaaagaaagaaagaaagaaaattggggataggagaacagcaaggtgggcatttcccggaattgtgtgcagatgcatccagtcgtggcattgcaagaagtctgtctgatgaagctcgggaagcattttgcaatattccctttggctgtgttcctgtgttccctgctcccacttttcttcccctggtttgtgattattaggagagaggttttgcaaagactcgttgctgtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctcta

SEQ ID NO: 71963 - DNA, 7159 bp, Homo sapiens
tgaggaccccaaacacgcatatcaagattggctccacgaaagtgatacggaggttaggatgctacttgctgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgtcaagggatatatttctatccctgccagcacagtgctggacatagtgagtactgaacacctaagaggcactcattcagactgacttctacaggacttctacgtgtgtgataaaagcctgtgaatcgtgagtccctgaaatatggtagcctggcccagcttctaaagaggaccttcgtagccacaaggcatgctaaacctctagggtctgatgctgtttttgttccaaatataaacgaaaggcactagtcagccgcctgcatagactttctaaacagtgagtaaataccatggaatgtcagaaatgactttatcatcgtcatcttgaagaaaaatatgaacactgatgaaggtcattttttttttttgacatctttctgtggcaaagctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaaaagcattaattgttcactggcaattactaaatgtattttgttgctctgagaaactcagcagtgtactgagatgtggctggctgtgccatcgtcatagtgcacagtgacttttctgtttcttatcactaaagactgaggtgaggttatgaaactttcattggtcccatcgttgtgcgcagggtgcaactggctacctagaagctgatggcaggagactgtttcacacacaggagattgtgagctgtgtaagtagtcatcgccactcaagtaggacaagggtcctacccaaggctaggaccgccctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacgaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatctcaaaaaaaaaaaaaagaaagaaagaaactgaaaagtgaggtgtggaactccaggcaacgacccaagcacttattttttaagagggaaaggactttggtcatgtttacattggcctttggtttttttttttctttcagccacaactatatgctgatataactcagccatcacttttgagttttgtttttaaatgaaggttaaatgtgacctgtgccctcacatttaattccgtttcatggagacatcttcctgactttgttggatagctgccactagggttgcttcgatcttcagccacatgctgtccttgaagcagctatttgaagatgtgttttctgaggaaaacaggctacaactgtttattaaaaccacttgcagtgcattcgtttatcagatgctcagtgcaaagtgtaattgggtcatggtcaaaaacgcttgcaacatctaattggcgttcaagatagtcattcaaaagttcttggcccgctgaagtctgttaacagttgaaacattctacagttaaccattagcatgctagttgtcctaatggaaatttttgaagagtttttcaatatataccctacccttgccaggaagagaagtaaaatcctcaggttgtggggtatttgtttctactccagcctggcaggcaaggctaaaacctgagattatcgatctatgagacatcttgatatgtaaagcacttaatattaaaggcataaaagtgaaactgctaaatatgtatagagaggttgacgtgtgatacgtgggacagttcacatagacatcagagaatttattccagaaaggagcctcctgaatgtgatgaatacggcaaagcctttaatcacatctcagcccttagcatcggaaagcttatactgtaaataaacttgatgaatattatatgtgaggaaaactttcatgtatagcactcattgcttcagacagaaaatgaattccgtcggtatgttccaatcgtgatgaatttgagaaacattgcaagagggagctcaatcttggccgggcgcagtggctcacgcctgtaatcgcagcactttgggaggccgaggcaggcggatcacgaggtcagtagttcgagaccagcctggccaacatggtgaaaccttgtctctactaaaaatacaaaaaaaaattagctgggcacagtggcgcacgcctgtagtcccagctactcgggaggctgaggcaggagaatggcttgaacctgcgaggcggaggttgcagtgagctaagatcatgccactggcactccagccttgagtgacagagcgaggctctgtatcaaaaaaaaaagttgcgggggggtgctcaatcttaactgcagaggatctacagatgaaaaaaaatgtggggaaatgctttaaaaaaatagcaaaatgtgcaacttcttacaaaaattgttaacgttaggtacttctatatattttatatgaccataatgtccgtgtgtgttttgtaccttcagtcccttgttattgttccgtatattacctgtaagcagatactgtattttattttagcctatttgacagaacacatcactcagaaaaagtgaagtttcagagcaaacagtgaagaaatcagtgtgattgtagacaaaaagtcggttcacagaacggagcagcggggagaggaagggaaaagcttcatagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtggcgggcgcctgtagtcccagctactcaggaggctgaggcaggaggatcacttgaacatgggaggcggaggttgcagtgagccaagatggcgccactgcactccagcctgggtgatggcgtgagactccatgtcaaaaaaaaaaacaaaggttggggggaggataggactggccaggcacggtggctcactcctgtaatctcagcactttgggaggcagaggtgggcggatcacttgaggtcaggagtttgagaccagcctggccaacgtggtgaaagcctgtctctactaaaaatacaaaaattagccgggcgtggtggtgggcgcctgtagtcccagctactcaggaggctgaggcaggagaatcacctaaatctgggaggcagaggttgcagtgagccgagattgcaccactgcactccagcctgggtaacagagactctgtctcaaaaaaagaaaaaaagaaagaaagaaagaaagaaaattggggataggagaacagcaaggtgggcatttcccggaattgtgtgcagatgcatccagtcgtggcattgcaagaagtctgtctgatgaagctcgggaagcattttgcaatattccctttggctgtgttcctgtgttccctgctcccacttttcttcccctggtttgtgattattaggagagaggttttgcaaagactcgttgctgtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctcta

SEQ ID NO: 71964 - DNA, 5565 bp, Homo sapiens
tgatctagaggatcccgatttgacgcgtctcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatctcaaaaaaaaaaaaaagaaagaaagaaactgaaaagtgaggtgtggaactccaggcaacgacccaagcacttattttttaagagggaaaggactttggtcatgtttacattggcctttggtttttttttttctttcagccacaactatatgctgatataactcagccatcacttttgagttttgtttttaaatgaaggttaaatgtgacctgtgccctcacatttaattccgtttcatggagacatcttcctgactttgttggatagctgccactagggttgcttcgatcttcagccacatgctgtccttgaagcagctatttgaagatgtgttttctgaggaaaacaggctacaactgtttattaaaaccacttgcagtgcattcgtttatcagatgctcagtgcaaagtgtaattgggtcatggtcaaaaacgcttgcaacatctaattggcgttcaagatagtcattcaaaagttcttggcccgctgaagtctgttaacagttgaaacattctacagttaaccattagcatgctagttgtcctaatggaaatttttgaagagtttttcaatatataccctacccttgccaggaagagaagtaaaatcctcaggttgtggggtatttgtttctactccagcctggcaggcaaggctaaaacctgagattatcgatctatgagacatcttgatatgtaaagcacttaatattaaaggcataaaagtgaaactgctaaatatgtatagagaggttgacgtgtgatacgtgggacagttcacatagacatcagagaatttattccagaaaggagcctcctgaatgtgatgaatacggcaaagcctttaatcacatctcagcccttagcatcggaaagcttatactgtaaataaacttgatgaatattatatgtgaggaaaactttcatgtatagcactcattgcttcagacagaaaatgaattccgtcggtatgttccaatcgtgatgaatttgagaaacattgcaagagggagctcaatcttggccgggcgcagtggctcacgcctgtaatcgcagcactttgggaggccgaggcaggcggatcacgaggtcagtagttcgagaccagcctggccaacatggtgaaaccttgtctctactaaaaatacaaaaaaaaattagctgggcacagtggcgcacgcctgtagtcccagctactcgggaggctgaggcaggagaatggcttgaacctgcgaggcggaggttgcagtgagctaagatcatgccactggcactccagccttgagtgacagagcgaggctctgtatcaaaaaaaaaagttgcgggggggtgctcaatcttaactgcagaggatctacagatgaaaaaaaatgtggggaaatgctttaaaaaaatagcaaaatgtgcaacttcttacaaaaattgttaacgttaggtacttctatatattttatatgaccataatgtccgtgtgtgttttgtaccttcagtcccttgttattgttccgtatattacctgtaagcagatactgtattttattttagcctatttgacagaacacatcactcagaaaaagtgaagtttcagagcaaacagtgaagaaatcagtgtgattgtagacaaaaagtcggttcacagaacggagcagcggggagaggaagggaaaagcttcatagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtggcgggcgcctgtagtcccagctactcaggaggctgaggcaggaggatcacttgaacatgggaggcggaggttgcagtgagccaagatggcgccactgcactccagcctgggtgatggcgtgagactccatgtcaaaaaaaaaaacaaaggttggggggaggataggactggccaggcacggtggctcactcctgtaatctcagcactttgggaggcagaggtgggcggatcacttgaggtcaggagtttgagaccagcctggccaacgtggtgaaagcctgtctctactaaaaatacaaaaattagccgggcgtggtggtgggcgcctgtagtcccagctactcaggaggctgaggcaggagaatcacctaaatctgggaggcagaggttgcagtgagccgagattgcaccactgcactccagcctgggtaacagagactctgtctcaaaaaaagaaaaaaagaaagaaagaaagaaagaaaattggggataggagaacagcaaggtgggcatttcccggaattgtgtgcagatgcatccagtcgtggcattgcaagaagtctgtctgatgaagctcgggaagcattttgcaatattccctttggctgtgttcctgtgttccctgctcccacttttcttcccctggtttgtgattattaggagagaggttttgcaaagactcgttgctgtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctcta

SEQ ID NO: 71965 - DNA, 5324 bp, Homo sapiens
tggcagtacagtgagactgtgttcaaaaaaacaaattacaagtatatcttacatagaagatgagatctacattatggatttctgccttgtgagagggcctaggaatgcacggtggttaaaaaaaacaaaaatctgctggctgggcgcggcggctcacgtctgtcatcccagcactttgggaggccgaggtcggctgatcacctgaggtcaggaattcaaaaacagccgggccaccacagcaaaaccctgtctctactacaaatacatggaggcggttgcctgggaggcagttctgctccgttcccatggattacaatttaggtgcctctgtcgggggaatatctctttcctagcagagatgaccaggcgaactgatcatccgtctaatcccaacccattgtcccggtaccacattcccgaaactaccaagcatccttctgttggctttctgtcttcttccatcctgtgtgattagtgtgattccaatacactgctttgtgtaattccacgaacttgcacctggactgtccttgtgatgaggattcccagcttccaaacttaatggtgattttctatgaagagctctgggtcctggatgtgtagtaagaacgaggaagttcaagaggcatcagccagataagacaaggtgacactgttggcagacatttccatttgtctctgctggatcttaacccctcaggacagtgctgcaaagaagccctcacgtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctgctgaggcaggagaatggcttgaacctgcgaggcggaggttgcagtgagctaagatcatgccactggcactccagccttgagtgacagagcgaggctctgtatcaaaaaaaaaagttgcgggggggtgctcaatcttaactgcagaggatctacagatgaaaaaaaatgtggggaaatgctttaaaaaaatagcaaaatgtgcaacttcttacaaaaattgttaacgttaggtacttctatatattttatatgaccataatgtccgtgtgtgttttgtaccttcagtcccttgttattgttccgtatattacctgtaagcagatactgtattttattttagcctatttgacagaacacatcactcagaaaaagtgaagtttcagagcaaacagtgaagaaatcagtgtgattgtagacaaaaagtcggttcacagaacggagcagcggggagaggaagggaaaagcttcatagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtggcgggcgcctgtagtcccagctactcaggaggctgaggcaggaggatcacttgaacatgggaggcggaggttgcagtgagccaagatggcgccactgcactccagcctgggtgatggcgtgagactccatgtcaaaaaaaaaaacaaaggttggggggaggataggactggccaggcacggtggctcactcctgtaatctcagcactttgggaggcagaggtgggcggatcacttgaggtcaggagtttgagaccagcctggccaacgtggtgaaagcctgtctctactaaaaatacaaaaattagccgggcgtggtggtgggcgcctgtagtcccagctactcaggaggctgaggcaggagaatcacctaaatctgggaggcagaggttgcagtgagccgagattgcaccactgcactccagcctgggtaacagagactctgtctcaaaaaaagaaaaaaagaaagaaagaaagaaagaaaattggggataggagaacagcaaggtgggcatttcccggaattgtgtgcagatgcatccagtcgtggcattgcaagaagtctgtctgatgaagctcgggaagcattttgcaatattccctttggctgtgttcctgtgttccctgctcccacttttcttcccctggtttgtgattattaggagagaggttttgcaaagactcgttgctgtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctcta

SEQ ID NO: 71966 - DNA, 4099 bp, Homo sapiens
  misc_feature (12)..(12): n is a, c, g, or t
  misc_feature (23)..(23): n is a, c, g, or t
tacggctaggtncgaggctgggngttgatgaatattatatgtgaggaaaactttcatgtatagcactcattgcttcagacagaaaatgaattccgtcggtatgttccaatcgtgatgaatttgagaaacattgcaagagggagctcaatcttggccgggcgcagtggctcacgcctgtaatcgcagcactttgggaggccgaggcaggcggatcacgaggtcagtagttcgagaccagcctggccaacatggtgaaaccttgtctctactaaaaatacaaaaaaaaattagctgggcacagtggcgcacgcctgtagtcccagctactcgggaggctgaggcaggagaatggcttgaacctgcgaggcggaggttgcagtgagctaagatcatgccactggcactccagccttgagtgacagagcgaggctctgtatcaaaaaaaaaagttgcgggggggtgctcaatcttaactgcagaggatctacagatgaaaaaaaatgtggggaaatgctttaaaaaaatagcaaaatgtgcaacttcttacaaaaattgttaacgttaggtacttctatatattttatatgaccataatgtccgtgtgtgttttgtaccttcagtcccttgttattgttccgtatattacctgtaagcagatactgtattttattttagcctatttgacagaacacatcactcagaaaaagtgaagtttcagagcaaacagtgaagaaatcagtgtgattgtagacaaaaagtcggttcacagaacggagcagcggggagaggaagggaaaagcttcatagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtggcgggcgcctgtagtcccagctactcaggaggctgaggcaggaggatcacttgaacatgggaggcggaggttgcagtgagccaagatggcgccactgcactccagcctgggtgatggcgtgagactccatgtcaaaaaaaaaaacaaaggttggggggaggataggactggccaggcacggtggctcactcctgtaatctcagcactttgggaggcagaggtgggcggatcacttgaggtcaggagtttgagaccagcctggccaacgtggtgaaagcctgtctctactaaaaatacaaaaattagccgggcgtggtggtgggcgcctgtagtcccagctactcaggaggctgaggcaggagaatcacctaaatctgggaggcagaggttgcagtgagccgagattgcaccactgcactccagcctgggtaacagagactctgtctcaaaaaaagaaaaaaagaaagaaagaaagaaagaaaattggggataggagaacagcaaggtgggcatttcccggaattgtgtgcagatgcatccagtcgtggcattgcaagaagtctgtctgatgaagctcgggaagcattttgcaatattccctttggctgtgttcctgtgttccctgctcccacttttcttcccctggtttgtgattattaggagagaggttttgcaaagactcgttgctgtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctcta

SEQ ID NO: 71967 - DNA, 4107 bp, Homo sapiens
aaagggaaaaacggccataggacgagcgcgtgttgatgaatattatatgtgaggaaaactttcatgtatagcactcattgcttcagacagaaaatgaattccgtcggtatgttccaatcgtgatgaatttgagaaacattgcaagagggagctcaatcttggccgggcgcagtggctcacgcctgtaatcgcagcactttgggaggccgaggcaggcggatcacgaggtcagtagttcgagaccagcctggccaacatggtgaaaccttgtctctactaaaaatacaaaaaaaaattagctgggcacagtggcgcacgcctgtagtcccagctactcgggaggctgaggcaggagaatggcttgaacctgcgaggcggaggttgcagtgagctaagatcatgccactggcactccagccttgagtgacagagcgaggctctgtatcaaaaaaaaaagttgcgggggggtgctcaatcttaactgcagaggatctacagatgaaaaaaaatgtggggaaatgctttaaaaaaatagcaaaatgtgcaacttcttacaaaaattgttaacgttaggtacttctatatattttatatgaccataatgtccgtgtgtgttttgtaccttcagtcccttgttattgttccgtatattacctgtaagcagatactgtattttattttagcctatttgacagaacacatcactcagaaaaagtgaagtttcagagcaaacagtgaagaaatcagtgtgattgtagacaaaaagtcggttcacagaacggagcagcggggagaggaagggaaaagcttcatagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtggcgggcgcctgtagtcccagctactcaggaggctgaggcaggaggatcacttgaacatgggaggcggaggttgcagtgagccaagatggcgccactgcactccagcctgggtgatggcgtgagactccatgtcaaaaaaaaaaacaaaggttggggggaggataggactggccaggcacggtggctcactcctgtaatctcagcactttgggaggcagaggtgggcggatcacttgaggtcaggagtttgagaccagcctggccaacgtggtgaaagcctgtctctactaaaaatacaaaaattagccgggcgtggtggtgggcgcctgtagtcccagctactcaggaggctgaggcaggagaatcacctaaatctgggaggcagaggttgcagtgagccgagattgcaccactgcactccagcctgggtaacagagactctgtctcaaaaaaagaaaaaaagaaagaaagaaagaaagaaaattggggataggagaacagcaaggtgggcatttcccggaattgtgtgcagatgcatccagtcgtggcattgcaagaagtctgtctgatgaagctcgggaagcattttgcaatattccctttggctgtgttcctgtgttccctgctcccacttttcttcccctggtttgtgattattaggagagaggttttgcaaagactcgttgctgtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctcta

SEQ ID NO: 71968 - DNA, 3661 bp, Homo sapiens
tctagagtatccccggtcatcttgctacaccattactgcagaggatctacagatgaaaaaaaatgtggggaaatgctttaaaaaaatagcaaaatgtgcaacttcttacaaaaattgttaacgttaggtacttctatatattttatatgaccataatgtccgtgtgtgttttgtaccttcagtcccttgttattgttccgtatattacctgtaagcagatactgtattttattttagcctatttgacagaacacatcactcagaaaaagtgaagtttcagagcaaacagtgaagaaatcagtgtgattgtagacaaaaagtcggttcacagaacggagcagcggggagaggaagggaaaagcttcatagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtggcgggcgcctgtagtcccagctactcaggaggctgaggcaggaggatcacttgaacatgggaggcggaggttgcagtgagccaagatggcgccactgcactccagcctgggtgatggcgtgagactccatgtcaaaaaaaaaaacaaaggttggggggaggataggactggccaggcacggtggctcactcctgtaatctcagcactttgggaggcagaggtgggcggatcacttgaggtcaggagtttgagaccagcctggccaacgtggtgaaagcctgtctctactaaaaatacaaaaattagccgggcgtggtggtgggcgcctgtagtcccagctactcaggaggctgaggcaggagaatcacctaaatctgggaggcagaggttgcagtgagccgagattgcaccactgcactccagcctgggtaacagagactctgtctcaaaaaaagaaaaaaagaaagaaagaaagaaagaaaattggggataggagaacagcaaggtgggcatttcccggaattgtgtgcagatgcatccagtcgtggcattgcaagaagtctgtctgatgaagctcgggaagcattttgcaatattccctttggctgtgttcctgtgttccctgctcccacttttcttcccctggtttgtgattattaggagagaggttttgcaaagactcgttgctgtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctcta

SEQ ID NO: 71969 - DNA, 3292 bp, Homo sapiens
taccccaccaacccacaaggctagcagccgggtgcatgaacgagggtcaaaaacgcttgcaacatctaattggcgttcaagatagtcattcaaaagttcttggcccgctgaagtctgttaacagttgaaacattctacagttaaccattagcatgctagttgtcctaatggaaatttttgaagagtttttcaatatataccctacccttgccaggaagagaagtaaaatcctcaggttgtggggtatttgtttctactccagcctggcaggcaaggctaaaacctgagattatcgatctatgagacatcttgatatgtaaagcacttaatattaaaggcataaaagtgaaactgctaaatatgtatagagaggttgacgtgtgatacgtgggacagttcacatagacatcagagaatttattccagaaaggagcctcctgaatgtgatgaatacggcaaagcctttaatcacatctcagcccttagcatcggaaagcttatactgtaaataaacttgatgaatattatatgtgaggaaaactttcatgtatagcactcattgcttcagacagaaaatgaattccgtcggtatgttccaatcgtgatgaatttgagaaacattgcaagagggagctcaatcttggccgggcgcagtggctcacgcctgtaatcgcagcactttgggaggccgaggcaggcggatcacgaggtcaggagtttgagaccagcctggccaacgtggtgaaagcctgtctctactaaaaatacaaaaattagccgggcgtggtggtgggcgcctgtagtcccagctactcaggaggctgaggcaggagaatcacctaaatctgggaggcagaggttgcagtgagccgagattgcaccactgcactccagcctgggtaacagagactctgtctcaaaaaaagaaaaaaagaaagaaagaaagaaagaaaattggggataggagaacagcaaggtgggcatttcccggaattgtgtgcagatgcatccagtcgtggcattgcaagaagtctgtctgatgaagctcgggaagcattttgcaatattccctttggctgtgttcctgtgttccctgctcccacttttcttcccctggtttgtgattattaggagagaggttttgcaaagactcgttgctgtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctcta

SEQ ID NO: 71970 - DNA, 2496 bp, Homo sapiens
cgtgtagtgcaggttatttggggggccaaggtgggaggatcagttgagcccaggaggtcgaggttgcagtgagccgagattgcaccactgcactccagcctgggtaacagagactctgtctcaaaaaaagaaaaaaagaaagaaagaaagaaagaaaattggggataggagaacagcaaggtgggcatttcccggaattgtgtgcagatgcatccagtcgtggcattgcaagaagtctgtctgatgaagctcgggaagcattttgcaatattccctttggctgtgttcctgtgttccctgctcccacttttcttcccctggtttgtgattattaggagagaggttttgcaaagactcgttgctgtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctcta

SEQ ID NO: 71971 - DNA, 1582 bp, Homo sapiens
ttaattctgcaaaggagaatgaagttgactgtgtggagatatttcttcttgtgtccatccctagcaacctcagatgactttaacttgaccctgggtcctgccaggtgactctgtcccccagatagttgtaaatggccgccatttacaactatcttcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctcta

SEQ ID NO: 71972 - DNA, 829 bp, Homo sapiens
ttgagagctcagccagcgttagggctgcttagttctcatggcccagtggctggtctcacccaactgcagtttactattgctatcttttctggatgatcagtcagattttcttatcctacactcgcttgtcctgttcgcgccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctcta

SEQ ID NO: 71973 - DNA, 187 bp, Homo sapiens
agtagtttttgctctttaaaatcagaaataattgagttccaagtcctcacctcttcagccactcagttgcctgggaggcagttctgctccgttcccatggattacaatttaggtgcctctgtcgggggaatatctctttcctagcagagatgaccaggcgaactgatcatccgtctaatcccaaccc

SEQ ID NO: 71974 - DNA, 139 bp, Homo sapiens
aaaaaggtgcgatttgaattttctatttattatgtcaggtggtgaaaacaggaatgagaacgaggagtcaacctcaaaggctgaaacctcggaagattcagcatcacgcggggagacaacaggaagatcccagaaagag

SEQ ID NO: 71975 - DNA, 375 bp, Homo sapiens
tactcacgtgagggcttctttgcagcactgtcctgaggggttaagatccagcagagacaaatggaaatgtctgccaacagtgtcaccttgtcttatctggctgatgcctcttgaacttcctcgttcttactacacatccaggacccagagctcttcatagaaaatcaccattaagtttggaagctgggaatcctcatcacaaggacagtccaggtgcaagttcgtggaattacacaaagcagtgtattggaatcacactaatcacacaggatggaagaagacagaaagccaacagaaggatgcttggtagtttcgggaatgtggtaccgggacaatgggttgggattagacggatgatcagttcgcctggtcatc

SEQ ID NO: 71976 - DNA, 1847 bp, Homo sapiens
actaattggatgtggggattaaggaaaggtaagcatcaaagattacctccaagtttgttagaaggttagtagcaggattctgatgccattcaagtaaatacaggtctcagtcagatgaaccccaggagccacatgtatttgaggggtactttgtctcacacttttacctgttacatggttttcagtaatttagaatttaagccagtagtggggcgactgtacatctatcgacatggtgaggtagagcatgtttgggaggaaagacgttgaatcccatttggtgacagtgagcttgaggtgctgccagaacactgcactgaagataggaggagactgtaggaaatacaagataggaaaggtctccactgaaatgttaactctttctctctaaacggccatccaggcctcaatgtctgcagtttctgatctgtgattatgacttatccaaatcttacatttcttaaaaatagtcatagatgaagggaatcacagttgatagttatatggtgacattagtggcttaaattctaaataactggaaactgtataataggcaaaactgtgaggcaaataaaatgcttctcaaatctgtgtggctcttatggggttaatttgatttggacctgtattaatttcttatggctgctataactaacaaattaccacaaacttggtggtttaaaacaacacacatttattctctttctgttctggaggccagaagtctaaaatgagattcactgggctgcagttcactgggcaaggccatgctcctctggaggcttccatgatgcatcccatattcagtgtttcccgagtaagccccacccatgcaggtctgcagttttacctcaacaggcttttgcactcagtggctctctcctgtggtttctatctgaaattctcttcattttttttttaataactgctttattgagatataattcacatgccacacaattcacctatacagtatacaattcagtagtgtttactatattcagagttgtgcaactatcatttttctcacccccaaaagaaaccctatgcccgttagtattcactctgttttctcacaactctaggtaaccactaatctactctccatctctatagatttgcccatgctagacatttcatataaatggaatcatacatgtggtctttttcactgagtatattttcaaggtgcatcccagctgtggcatgaatcagcatctcattcctttttattgccaaataatattctatcatatggatatgtcgcattttatgtatccattcatcagctgatggacatttgggttgtttgtactttttggctaccatgaataatgctactatgaacttttgtgtacaaatcttatgtggacttgttttcatttctcttggatgtatattcctaggagaatggctggattatacagtaactctttcctcataactttgcatatcaaaattatatccatctttcagaacccaaattcagtgttatttccaaagtgttccaacatctcccactcaaaatgaatcttctccctagtactcccattgtttagtacctaattgttcttaccagtttgtcttagagctcagtcattcctacacagcacttttcttcattatactgctaatttcattacactgtaagagtggggacaagctgttcttcttgtataccagaaagtagtgagtgcactgctgtgaagaaagcaggaactcaaaagttaagaattttgaatgagcctataaaatgtgtctaataaataataatgttcattttcaaatctcaacaattaaatgtttaacaaataacacttgaaataaatgtttattagaaaaaccaa

SEQ ID NO: 71977 - DNA, 725 bp, Homo sapiens
gggggggggttaccaaaaaaaaaaattttaaaaaaaaaaaaaaaccttgttggccggggtactcccattgtttagtacctaattgttcttaccagtttgtcttagagctcagtcattcctacacagcacttttcttcattatactgctaatttcattacactgtaagagtggggacaagctgttcttcttgtataccagaaagtagtgagtgcactgctgtgaagaaagcaggaactcaaaagttaagaattttgaatgagcctataaaatgtgtctaataaataataatgttcattttcaaatctcaacaattaaatgtttaacaaataacacttgaaataaatgtttattagaaaaaccaaaccaaaaaataaaaaatataaaaaaacaagaacatgaaaaaagaaggaaaaataactaaaaatatttacgaataataggttataaactctaatctttatggcgtcaaagtttctgtttcgtaatgaggaatatcttgtattctttattgtcacagatttttttatactttgacacgttatttgtctgggcccctaatggttgttctattggataaacttccctattttggtgtggtatataaaattggttgccttagatttactacctttctctctggtcctctgggtccttccactattattggctcgtgtatcctctttttttgaatctggtgtttttctattggtctccatcttcttct

SEQ ID NO: 71978 - DNA, 3578 bp, Homo sapiens
actaattggatgtggggattaaggaaaggtaagcatcaaagattacctccaagtttgttagaaggttagtagcaggattctgatgccattcaagtaaatacaggtctcagtcagatgaaccccaggagccacatgtatttgaggggtactttgtctcacacttttacctgttacatggttttcagtaatttagaatttaagccagtagtggggcgactgtacatctatcgacatggtgaggtagagcatgtttgggaggaaagacgttgaatcccatttggtgacagtgagcttgaggtgctgccagaacactgcactgaagataggaggagactgtaggaaatacaagataggaaaggtctccactgaaatgttaactctttctctctaaacggccatccaggcctcaatgtctgcagtttctgatctgtgattatgacttatccaaatcttacatttcttaaaaatagtcatagatgaagggaatcacagttgatagttatatggtgacattagtggcttaaattctaaataactggaaactgtataataggcaaaactgtgaggcaaataaaatgcttctcaaatctgtgtggctcttatggggttaatttgatttggacctgtattaatttcttatggctgctataactaacaaattaccacaaacttggtggtttaaaacaacacacatttattctctttctgttctggaggccagaagtctaaaatgagattcactgggctgcagttcactgggcaaggccatgctcctctggaggcttccatgatgcatcccatattcagtgtttcccgagtaagccccacccatgcaggtctgcagttttacctcaacaggcttttgcactcagtggctctctcctgtggtttctatctgaaattctcttcattttttttttaataactgctttattgagatataattcacatgccacacaattcacctatacagtatacaattcagtagtgtttactatattcagagttgtgcaactatcatttttctcacccccaaaagaaaccctatgcccgttagtattcactctgttttctcacaactctaggtaaccactaatctactctccatctctatagatttgcccatgctagacatttcatataaatggaatcatacatgtggtctttttcactgagtatattttcaaggtgcatcccagctgtggcatgaatcagcatctcattcctttttattgccaaataatattctatcatatggatatgtcgcattttatgtatccattcatcagctgatggacatttgggttgtttgtactttttggctaccatgaataatgctactatgaacttttgtgtacaaatcttatgtggacttgttttcatttctcttggatgtatattcctaggagaatggctggattatacagtaactctttcctcataactttgcatatcaaaattatatccatctttcagaacccaaattcagtgttatttccaaagtgttccaacatctcccactcaaaatgaatcttctccctagtactcccattgtttagtacctaattgttcttaccagtttgtcttagagctcagtcattcctacacagcacttttcttcattatactgctaatttcattacactgtaagagtggggacaagctgttcttcttgtataccagaaagtagtgagtgcactgctgtgaagaaagcaggaactcaaaagttaagaattttgaatgagcctataaaatgtgtctaataaataataatgttcattttcaaatctcaacaattaaatgtttaacaaataacacttgaaataaatgtttattagaaaaaccaatttggtatgttaaagtatttattttgaatttcagaaactacagaattctggatttttaattaagaaaattagacattttagaatttctagataggactttgaaaataaacatggcacaatatacacaaaagtaaatgacaacatgacattaaattttacattgttttgcagtttcaaatttcgtattaatgttctacaacaaattttaaaattcttttcagtgttttgcttcccttggtgttcattattgcctatttataaagtcataaaaggcctaaaaataacttgttactcatattgaaagtctgattttttttttattcccttaagatggaggtctctcactatgttgcccaggctggtttcaaacttctgggctcaaaggattccccatctcagccccctgagtagctgggaccaaaggcatgcaccactgcacccggctgaaagcctgtatttttatctttcgatggacaacagagggatatctcccactctctaagccggtctagttctagtactaggcctgtaaatgtagaccacaatcctggtgaagtcatgggttccatcagtgttatcctggcattctcagcataattgtcatgaacatatttaaaatattttaggccactgagcaggtgtgggttgtcctcatagtaacaggagaaagggaagccagttcctgtctaactccattccatctgaaattatccatttggctttgggatttgactgaatgttggtatgttggctgaaatgacaccacagtattgactggaattgcaagggtaaaatgtactcctctgttttattaatagctctctctctctctctctctctatatatatatatatatacatacatatatatatataatttttttttttgagacagggtcttgctctgtcacccaggctggagtgcagcagcatgatctcagctcactgcaatatctgcctcccaggttcaagcaattctcatgcctccgccttctgagtagctgggattacaggcgaatgccaccacgcccagctaatttttgtatttttagtagagatggggtttcaccatgttggccaggttggtcttgaactcctggcttcaagtgatctgcctgccttggcgtcctaaagtgctgggattacaggagtgaaccactgcgctcagccaattttataatttttttaaaaacaaaaaagtaaatattaaacaatagcatccaaacatataaatattatatatatacacatatttacattcataaaaataatgattagttttctggatgaagaactgaggcccagaagttaactagattagtggctcaaggtaggctgcattttagaatcaagggcagtgatgcccaagtcacagtgactaatggcatcagaatctcttgggatgggacccttttattactattttgtaaagctccccaagttaaacttgaaaagtgaattaggtcatattaggtcagagattaatacaaattgtactactgattatcttaccctagcaagtgtaggttaatttttacaatcttcttatgtatgctgtttctaataaaaggggttgttctcttgctcaatctaactaacaggtgagctataaaatcacacaggtgatcacaactctatccaaagaatggtggtgctccatccttaacctcagtactagttcttatcctcaggtgcttatcactcattcttgggacttcaaaataaatatata

SEQ ID NO: 71979 - DNA, 3426 bp, Homo sapiens
  misc_feature (3214)..(3214): n is a, c, g, or t
  misc_feature (3374)..(3374): n is a, c, g, or t
gacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatagtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccacccccctcccccaagcctcccgccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaatgaattaccagagaaacagagatgggccgagattctcagaaatggtcccatgtgaccaagttctgctgtttgggtgacagtgctttgaagatctcctttgaggatgtgcagtcttttttttttttttttttttgagatggagtttgttgcccaggctggagtgagtggcacagtctcggctcactgcaacctccacctcctgggttcaagcagttctcgtgccgcagctactcaggaggccgagacatgagaatcgcttgaaccggggaggcagaggttgcagtgagctgagatcacaccatcgcactccagcctgggcaacagagcaagactccatctcaaaaaaaaaaaagaagtactaacttaatacaaaaaaaaaagtacaaaatgctaagaaagagattttatctgatggactctgagatttcatatgaaaatggtggtatctgaactcctttcagtgtagctgctgtaagaattctaatccctagccgggtgcagtggctcacacctgtaatcccagcactttgggatgctgaggcaggtggatcgcctgaggtnaggagttcaaaacaagcctagccaacatagtaaaaccccatctctactaaaaatacaaaaaattagctgggtgtggtggtgggagcctgtaatcccagctactagggaggctgaggcaggagaatcacttgaacccaggaggcagaggttgcagtgagcngaaattgtgccatcgcactccagcctgggcaacaagagcaaaactccgtctc

SEQ ID NO: 71980 - DNA, 941 bp, Homo sapiens
  misc_feature (729)..(729): n is a, c, g, or t
  misc_feature (889)..(889): n is a, c, g, or t
ttagatcttattattagtagaaatgagcaatttttgagttctagtctttctttgccctcctcccaaaatttacagatttatcttactatccttaatgttttggaaattgaggttccttaattcaatttaacacatagttattaaacacattctaagtatcaggtctataagggagacaaagatgaattaacatcatgcctccttgcccttaagaagtactaacttggccaggcacggtggctcacgcctgtaatcccagcactttgggagaccaaggcagttggatcacttgaggtcaggagttcgagaccagcctggccaacatggtgaaaccctgtttctactaaaaatacaaaaaattagctgggcgtggtggcaggcacctgtaatcccagctactcaggaggccgagacatgagaatcgcttgaaccggggaggcagaggttgcagtgagctgagatcacaccatcgcactccagcctgggcaacagagcaagactccatctcaaaaaaaaaaaagaagtactaacttaatacaaaaaaaaaagtacaaaatgctaagaaagagattttatctgatggactctgagatttcatatgaaaatggtggtatctgaactcctttcagtgtagctgctgtaagaattctaatccctagccgggtgcagtggctcacacctgtaatcccagcactttgggatgctgaggcaggtggatcgcctgaggtnaggagttcaaaacaagcctagccaacatagtaaaaccccatctctactaaaaatacaaaaaattagctgggtgtggtggtgggagcctgtaatcccagctactagggaggctgaggcaggagaatcacttgaacccaggaggcagaggttgcagtgagcngaaattgtgccatcgcactccagcctgggcaacaagagcaaaactccgtctc

SEQ ID NO: 71981 - DNA, 2073 bp, Homo sapiens
agattctgaaactctcccacctccccactcccacctacccccgatataaatcactggactgtttgtacgtgaaacagaagaggctaagcttcctttttttacacttatgagacaaaaagtgcagtgtttggttcgtatgtttagcacatgattttcataaagaatctatatatttttgccctacagagaattgttatacaggtcaagtgtgttttcctgatgttcctatgcagttacagtatgttgaaagtgttttaacactaagaagaaaactttaaagattcatgtgattaattggatttgaggataattattattatttggtttttagatttgaaaagtagaatttccattgagacaattgatttgaataggcctgcatttgattcttcatatcaatagaaactaaaatgatttgggagattcatttgaaaaatgattgtatacttgttcacaaagcgaaaagtgatacatgaaggtaatggttatcatttaaagcccacattttacactatcaggtcacaggagtctaatttttttttcagttagataaactgaccaaacgtctattcaagaatatatgtcaatatcatcctaatgtggaaggtccgaagaaccagaaaagtgagaagggccgtttacctccctctgtagctatcacctgttggtccacagagtttcttgagaaatgagcaaacattttatgattaggtaaccctttcacatgaacgggaagatgggaaaggtggaatgaccataagagttggcctgagaccagtttgttttctggggatttggtaagataggcagttcccatgggaaattgcttaaattgctttgttgcctatgatttgattctaaacaagtggtgctatcttctccctcaatatggctgtcttgagtttgtcttgcagtatcacaccattataccaattctttgggttgcttctgacacattcaaagtgaactctggctgatgttgctgtttcaggtataccatctggagttaatttcctagcagaaggtgaaagtccaggagaattgtcctctttcattgaacatgattgaaaatgtaactggctctgaacttcaagaagatagatgcccaagtgatgcattaaagtaagggaaataaagtcaagtttttcaactgccatccatattctcattggcagaattctgatttttttccaagcactgtttggtgagcctggaagcaccgtatcctgtcccagggagtacagtgaaatttccaagcaagagctgaggtgccaataccaaaagaccatggggagtctgcacggttctggttagatcaatagaaaatccatgtgtacaactgttaattcctcatcctccactagcactaaatttgtcactttaaattttgaaaccagggaaacaccacctgtcattctgtccccattctccatagctcttcaatctttacatgccgcaagacttttttgatagctcgtactcatcccagtgtctcctgaaaccccatcatgtaatgtactgggcaccttcttttaaacaaatgtttactctgtgggtttggttcatttcaatttctgcgttctgacacatatttttttaataaagatgagaaagagaaaatgactgttgcagtacctttctagacctactttaactttacctcagatgacagtttgttaacatatatggacacattatttttaactttatgtacaatgcattcaacagaacagcaaaatttttagaaattttccattaatttctgtaacacaccatgtaaaactgttacaaataaacatgtttgagacaacaaaaaaaaagaaaagtcgtattagcgccgagctatccgtaggtaggtatttgctgccagccgtcgttacagggctggaaccgggccgcttatgctggggtccgttcgccggctagggagcgaagtcggccaagtcgctggtgtggagtggccgttgggcgggacgcgtgtgtggcgagcacgcctggtttcttgtggcgctagagggctgttcacccaaaggtgcggcggcgttggatagccacatttggagaacacgtacg

SEQ ID NO: 71982 - DNA, 1812 bp, Homo sapiens
agattctgaaactctcccacctccccactcccacctacccccgatataaatcactggactgtttgtacgtgaaacagaagaggctaagcttcctttttttacacttatgagacaaaaagtgcagtgtttggttcgtatgtttagcacatgattttcataaagaatctatatatttttgccctacagagaattgttatacaggtcaagtgtgttttcctgatgttcctatgcagttacagtatgttgaaagtgttttaacactaagaagaaaactttaaagattcatgtgattaattggatttgaggataattattattatttggtttttagatttgaaaagtagaatttccattgagacaattgatttgaataggcctgcatttgattcttcatatcaatagaaactaaaatgatttgggagattcatttgaaaaatgattgtatacttgttcacaaagcgaaaagtgatacatgaaggtaatggttatcatttaaagcccacattttacactatcaggtcacaggagtctaatttttttttcagttagataaactgaccaaacgtctattcaagaatatatgtcaatatcatcctaatgtggaaggtccgaagaaccagaaaagtgagaagggccgtttacctccctctgtagctatcacctgttggtccacagagtttcttgagaaatgagcaaacattttatgattaggtaaccctttcacatgaacgggaagatgggaaaggtggaatgaccataagagttggcctgagaccagtttgttttctggggatttggtaagataggcagttcccatgggaaattgcttaaattgctttgttgcctatgatttgattctaaacaagtggtgctatcttctccctcaatatggctgtcttgagtttgtcttgcagtatcacaccattataccaattctttgggttgcttctgacacattcaaagtgaactctggctgatgttgctgtttcaggtataccatctggagttaatttcctagcagaaggtgaaagtccaggagaattgtcctctttcattgaacatgattgaaaatgtaactggctctgaacttcaagaagatagatgcccaagtgatgcattaaagtaagggaaataaagtcaagtttttcaactgccatccatattctcattggcagaattctgatttttttccaagcactgtttggtgagcctggaagcaccgtatcctgtcccagggagtacagtgaaatttccaagcaagagctgaggtgccaataccaaaagaccatggggagtctgcacggttctggttagatcaatagaaaatccatgtgtacaactgttaattcctcatcctccactagcactaaatttgtcactttaaattttgaaaccagggaaacaccacctgtcattctgtccccattctccatagctcttcaatctttacatgccgcaagacttttttgatagctcgtactcatcccagtgtctcctgaaaccccatcatgtaatgtactgggcaccttcttttaaacaaatgtttactctgtgggtttggttcatttcaatttctgcgttctgacacatatttttttaataaagatgagaaagagaaaatgactgttgcagtacctttctagacctactttaactttacctcagatgacagtttgttaacatatatggacacattatttttaactttatgtacaatgcattcaacagaacagcaaaatttttagaaattttccattaatttctgtaacacaccatgtaaaactgttacaaataaacatgtttgagacaaca

SEQ ID NO: 71983 - DNA, 1758 bp, Homo sapiens
agattctgaaactctcccacctccccactcccacctacccccgatataaatcactggactgtttgtacgtgaaacagaagaggctaagcttcctttttttacacttatgagacaaaaagtgcagtgtttggttcgtatgtttagcacatgattttcataaagaatctatatatttttgccctacagagaattgttatacaggtcaagtgtgttttcctgatgttcctatgcagttacagtatgttgaaagtgttttaacactaagaagaaaactttaaagattcatgtgattaattggatttgaggataattattattatttggtttttagatttgaaaagtagaatttccattgagacaattgatttgaataggcctgcatttgattcttcatatcaatagaaactaaaatgatttgggagattcatttgaaaaatgattgtatacttgttcacaaagcgcaggtcacaggagtctaatttttttttcagttagataaactgaccaaacgtctattcaagaatatatgtcaatatcatcctaatgtggaaggtccgaagaaccagaaaagtgagaagggccgtttacctccctctgtagctatcacctgttggtccacagagtttcttgagaaatgagcaaacattttatgattaggtaaccctttcacatgaacgggaagatgggaaaggtggaatgaccataagagttggcctgagaccagtttgttttctggggatttggtaagataggcagttcccatgggaaattgcttaaattgctttgttgcctatgatttgattctaaacaagtggtgctatcttctccctcaatatggctgtcttgagtttgtcttgcagtatcacaccattataccaattctttgggttgcttctgacacattcaaagtgaactctggctgatgttgctgtttcaggtataccatctggagttaatttcctagcagaaggtgaaagtccaggagaattgtcctctttcattgaacatgattgaaaatgtaactggctctgaacttcaagaagatagatgcccaagtgatgcattaaagtaagggaaataaagtcaagtttttcaactgccatccatattctcattggcagaattctgatttttttccaagcactgtttggtgagcctggaagcaccgtatcctgtcccagggagtacagtgaaatttccaagcaagagctgaggtgccaataccaaaagaccatggggagtctgcacggttctggttagatcaatagaaaatccatgtgtacaactgttaattcctcatcctccactagcactaaatttgtcactttaaattttgaaaccagggaaacaccacctgtcattctgtccccattctccatagctcttcaatctttacatgccgcaagacttttttgatagctcgtactcatcccagtgtctcctgaaaccccatcatgtaatgtactgggcaccttcttttaaacaaatgtttactctgtgggtttggttcatttcaatttctgcgttctgacacatatttttttaataaagatgagaaagagaaaatgactgttgcagtacctttctagacctactttaactttacctcagatgacagtttgttaacatatatggacacattatttttaactttatgtacaatgcattcaacagaacagcaaaatttttagaaattttccattaatttctgtaacacaccatgtaaaactgttacaaataaacatgtttgagacaaca

SEQ ID NO: 71984 - DNA, 1112 bp, Homo sapiens
ccattctcctgcctcagcctcctgagtagctgggactacaggcgcccgccaccacacccggctaactttttttgtatttttagtagaaacattgtttcaccacgttagccaggatggtctccatctcctgacctcgtgatccgcctgcctcggcctcccaaagtgctgggattacaggcgtgagccactgcacccagccgagtgagaatttttatgccataaaaatacgactctgaaagctacatggaaaaggagaatcccacctccttgcactacattgaaacaagcaagcctttccctccctctcctttttgatgttttcttgtcccaagacaaaagtttggcatcttggaacttattcatgctctctggctgcctttgtagacttttggagtcctttgcaaggtttggtggtctcgtcgttaatctggagaaattccccagaatctgtctcaaagcgctcaacctggctcagaggacacccagcccctatgccccactcacaagagaggtgggcaagcccccagggataggaggaagtaagcaggatcctccctgtcctgtttcccagaaccagagcaaggaatggggaatcctaagggtttctgtggcatcactgaatgtcacccactccacatcaacctgcctctcacctgccaccctttttcagggaggtgagtacctgccatggtcactgttaccagatccttaaaatcctgggctctgagctaggtgcattgctctgttacccatttcctacatttgtttgtttgttcttgatttcctgggggaatgggactgatggagacagacaaacccactgtgggcagcatctaagccatgtccaaggttggtcgaattaagggaaccctggcctctcagcaggacagaaagctgagctgtggttccaggccctcctctctgggcccctggtgtgtatcttttttccttgttgcttttgaaatttttgcaattattttaagaatccagtctttcagaccagcccttttattaagctttgaatttttaattgatttttttaaagtaaaaaaaaaaaaacccaaaaaacaaacaaaatttaacaaaaaaatccgctactcttactcccctgc

SEQ ID NO: 71985 - DNA, 967 bp, Homo sapiens
ccattctcctgcctcagcctcctgagtagctgggactacaggcgcccgccaccacacccggctaactttttttgtatttttagtagaaacattgtttcaccacgttagccaggatggtctccatctcctgacctcgtgatccgcctgcctcggcctcccaaagtgctgggattacaggcgtgagccactgcacccagccgagtgagaatttttatgccataaaaatacgactctgaaagctacatggaaaaggagaatcccacctccttgcactacattgaaacaagcaagcctttccctccctctcctttttgatgttttcttgtcccaagacaaaagtttggcatcttggaacttattcatgctctctggctgcctttgtagacttttggagtcctttgcaaggtttggtggtctcgtcgttaatctggagaaattccccagaatctgtctcaaagcgctcaacctggctcagaggacacccagcccctatgccccactcacaagagaggtgggcaagcccccagggataggaggaagtaagcaggatcctccctgtcctgtttcccagaaccagagcaaggaatggggaatcctaagggtttctgtggcatcactgaatgtcacccactccacatcaacctgcctctcacctgccaccctttttcagggaggtgagtacctgccatggtcactgttaccagatccttaaaatcctgggctctgagctaggtgcattgctctgttacccatttcctacatttgtttgtttgttcttgatttcctgggggaatgggactgatggagacagacaaacccactgtgggcagcatctaagccatgtccaaggttggtcgaattaagggaaccctggcctctcagcaggacagaaagctgagctgtggttccaggttggtcgaattaagggaacctggcctctcagcaggacagaaagctgagctgtggt

SEQ ID NO: 71986 - DNA, 4494 bp, Homo sapiens
  misc_feature (75)..(75): n is a, c, g, or t
ggtctttgacttctttctgaactcaatcttcccgtcacgttcctccaatactgaaggtctctctgcggcgcgganccgggcggctcggggcccagagagagccgcggccgggagctcgcgggctcctgacaacctcctcccctcggcggacgacgaccacggcgactagggcgccggtcatggcggagcaacaaacccggcgcggaccctaggcaccaccgcatggagcgggacgaaccgccgcctagcggagggggaggcggcgggggctcggcggggttcctggagcctcccgccgcgctccctccgccgccgcgcaacggtttctgtcaggatgaattggcagagcttgacccaggcactaatgatcgggctgaacaacgaacctgtctcatttgtggggaccgcgctacaggcttgcactatgggatcatctcctgtgagggctgcaaagggtttttcaagcggagcatttgcaacaaacgggtatatcgatgcagtcgtgacaagaactgtgtcatgtctcggaagcagaggaacaggtgccagtactgccgcctgctcaaatgcctccagatggggatgaaccggaaggctatcagagaagatggcatgcctggaggccggaataagagcattgggccagtccagatatcggaagaagaaatcgaaaggatcatgtctgggcaggagtttgaggaagaggccaatcactggagcaaccatggtgatagtgaccacagttcccctgggaacagggcttcggagagcaaccagccctcaccaggctccacactgtcttccagtaggtctgtggaactgaatggattcatggccttcagggaacagtacatgggaatgtctgtgcctccacattaccaatatataccgcacctttttagctattctggccactcaccacttctgccccaacaagctcgcagcctggatccccagtcatacagtctgattcaccagctgttatcagccgaggacctggaaccattgggcacgcccatgttgattgaagatggatacgctgtgacacaggcagaactatttgccctgctttgccgcctggccgacgagctgctctttaggcagattgcctggatcaagaaactgcctttcttctgcgagctctcaatcaaggattacacgtgcctcttgagctctacgtggcaggagctaatcctgctgtcttccctcaccgtttacagcaagcagatctttggggaactggctgatgtcactgccaagtactcgccctccgatgaagaactacacagatttagtgatgaagggatggaggtgatcgagcggctcatctacctctatcacaagttccatcagctaaaggtcagcaacgaggagtatgcttgcatgaaagcaattaacttcctaaatcaagatatcaggggtctgaccagtgcctcacagctggaacaattgaataaacgatactggtacatttgccaggattttactgaatataaatacacacatcagccgaaccgctttcctgatctcatgatgtgcttacctgagattcgatatattgcaggaaagatggtgaatgtgcccctggagcagctgcccctcctctttaaggtggtgctgcattcctgcaagaccagtgtgggcaaggaatgacctgttccaggcgccctcctcaggccaaccacagcgtcttgggtgggcaggacaggctctggagggaaaagccagagagaccaagatggaggctgtggagcagcatttcccgttgcctccatagcaagaagagtttttgtttgtttgtctgtttttttaacctcatttttctatatatttatttcacgacagagttgaatgtatggccttcaacatgatgcacatgcttttgtgtgaatgcagccaatgcattttcttacagtttacagaatgtgaagatgtttaatgttacagtgttgtcattgtttagaaatagttcttttgtattttgagggagagggtgggatggggctaagatgactatttccataatgttgacaaagatgactacctcaatggaaatggggggtgtggccatccctactttttccacattttctcagcagactcatacatttgtctgtcagagagcaaattgccaaaaaaagccacagaattgccagataaaatggcacactgtaagggcgcaaagtgttgttaggagattcactaagcaaggttggtgagacggcaacagggtaggaggtgaggattgagccacgtcctttccttggaaagcgtgaaaattaagagagtagggcacagtgaccatatttaaggcaggtgtccttccacccaacaagtcctaagggcagaagaatttctgttctcacaccttgctgccccccttacccctgcaccaccatcattgtctaccactgcgaactttccatctaggcaaagtcctggcaatcacttgatccacaggactcgcctcccagctccctcggggcccccagctacctagtttccttacctggatctcctgaggcccaccttcctccttcccactcccttacacatttgacttcctattggccctttgaaaaaccagctgagcagaatgccatgttctgaagcctggtgcccactactgatttattctcctttcaccttgttttcttcaaagggtagtagggcaaggccagactgcaaaaagaatagacactccccttttgaaatctgttcctctcccctccccttcctaccgcaccctcaggtctaaatccgaaaacttcaggcttttttaaacaatgagaaggaccattcacctgtctgctgaccagaaatgttgcccctaagttcttctccaagttctccttttctctccagagtgagaccagttttcctcagggacccaggacacaaagcccaaggcccagagtggctcagctgccccttacttcagcagtggactggccagccaaggcctggagggctggagccagaagcacctggaagggaaggggggctttaaactacctcaggttcctaatggcccggctgctacctctgcagacatggcctggactccttgacctctcactacctgccccaccttatcccaggacgtgttccttaccctcttgactttggccagcgctacaccaggtctgtctttgaactctttcaggtgcttgtcctgcctacacccaggtatctttcacagccagtgtggcaagcagaccacttagttggctgcatgcctgggtaggttggaagggcccacggcaccttcttctgcctatttagtcaaaggctgtttgctgtctcctcaactcaacctagtaaagctacccaggagggcaccacgtcgtgtgcatactgggtagtccatgtctgattgtaattgtttctttctggtgaaatgttacgggtaccagcagagtgatgattttggcccttgatggatctaaaactcggaacattactcctcaatgccgtttccccagttgctctgagaaggaagagacatgttcctcaggaaaagctccagctagcatgtttttcacgtcagtgggaagattcttgtgtgttcgtgtgtatctgtttatttctaagttcacgatacttgttcccctgaattttatttaaccaactagatcacattctttggccacaggtcagactctgagctgctttcctccagatcgggaaggagacacatatcacagatgccttctctaagacagctcctgtgtacagcatcgttctttgctgaggcctctatctgtccaattattatttttgaaattgcttttcaaattaaacattttacccgttgtgttgggtgtcaaaagaaattgctctctgatgaggcaagaacatgtctctccaacaacgtagtattgaacagagcaagttgttaatttgtggagtaggggaaaggttctgcaagttgccattgtacaaatccagttttacaaatgtttgcagcagattccacagacaaagagcccattcattgccgagagccctgcagaatctcagagcaaagtggctgtgtgttccgagccggagcctgacctgtggaccgtctttaatgtcttctgcaccagtccttttatgacgtgggctttttttaaacagggtaaagtgaatgtgttgcattgcaaactcaggtattatgaggagaaggtaggagtgtagctagcagcgtggagacattaggtcagccactagatgtatttgtgaatttggtttgaaggacacggagaaaggttggaggggaggttggtgtgtttgttttttgctttcttccccataatgtttggttaacaggtagcctttttgcgagtggaaggagagaaaagttgtgcatgttttctctaatttctctttctgccctctctctgatccccaaccaccaaaagcactcactttgagtgaggatttttttttttttttttttttttttgggggggggagtcccccttggggccccgggggggggtgcggggg

SEQ ID NO: 71987 - DNA, 4458 bp, Homo sapiens
  misc_feature (39)..(39): n is a, c, g, or t
ggcacgaggcggcgcggaggggcgcggagcggcgcgganccgggcggctcggggcccagagagagccgcggccgggagctcgcgggctcctgacaacctcctcccctcggcggacgacgaccacggcgactagggcgccggtcatggcggagcaacaaacccggcgcggaccctaggcaccaccgcatggagcgggacgaaccgccgcctagcggagggggaggcggcgggggctcggcggggttcctggagcctcccgccgcgctccctccgccgccgcgcaacggtttctgtcaggatgaattggcagagcttgacccaggcactaatgatcgggctgaacaacgaacctgtctcatttgtggggaccgcgctacaggcttgcactatgggatcatctcctgtgagggctgcaaagggtttttcaagcggagcatttgcaacaaacgggtatatcgatgcagtcgtgacaagaactgtgtcatgtctcggaagcagaggaacaggtgccagtactgccgcctgctcaaatgcctccagatggggatgaaccggaaggctatcagagaagatggcatgcctggaggccggaataagagcattgggccagtccagatatcggaagaagaaatcgaaaggatcatgtctgggcaggagtttgaggaagaggccaatcactggagcaaccatggtgatagtgaccacagttcccctgggaacagggcttcggagagcaaccagccctcaccaggctccacactgtcttccagtaggtctgtggaactgaatggattcatggccttcagggaacagtacatgggaatgtctgtgcctccacattaccaatatataccgcacctttttagctattctggccactcaccacttctgccccaacaagctcgcagcctggatccccagtcatacagtctgattcaccagctgttatcagccgaggacctggaaccattgggcacgcccatgttgattgaagatggatacgctgtgacacaggcagaactatttgccctgctttgccgcctggccgacgagctgctctttaggcagattgcctggatcaagaaactgcctttcttctgcgagctctcaatcaaggattacacgtgcctcttgagctctacgtggcaggagctaatcctgctgtcttccctcaccgtttacagcaagcagatctttggggaactggctgatgtcactgccaagtactcgccctccgatgaagaactacacagatttagtgatgaagggatggaggtgatcgagcggctcatctacctctatcacaagttccatcagctaaaggtcagcaacgaggagtatgcttgcatgaaagcaattaacttcctaaatcaagatatcaggggtctgaccagtgcctcacagctggaacaattgaataaacgatactggtacatttgccaggattttactgaatataaatacacacatcagccgaaccgctttcctgatctcatgatgtgcttacctgagattcgatatattgcaggaaagatggtgaatgtgcccctggagcagctgcccctcctctttaaggtggtgctgcattcctgcaagaccagtgtgggcaaggaatgacctgttccaggcgccctcctcaggccaaccacagcgtcttgggtgggcaggacaggctctggagggaaaagccagagagaccaagatggaggctgtggagcagcatttcccgttgcctccatagcaagaagagtttttgtttgtttgtctgtttttttaacctcatttttctatatatttatttcacgacagagttgaatgtatggccttcaacatgatgcacatgcttttgtgtgaatgcagccaatgcattttcttacagtttacagaatgtgaagatgtttaatgttacagtgttgtcattgtttagaaatagttcttttgtattttgagggagagggtgggatggggctaagatgactatttccataatgttgacaaagatgactacctcaatggaaatggggggtgtggccatccctactttttccacattttctcagcagactcatacatttgtctgtcagagagcaaattgccaaaaaaagccacagaattgccagataaaatggcacactgtaagggcgcaaagtgttgttaggagattcactaagcaaggttggtgagacggcaacagggtaggaggtgaggattgagccacgtcctttccttggaaagcgtgaaaattaagagagtagggcacagtgaccatatttaaggcaggtgtccttccacccaacaagtcctaagggcagaagaatttctgttctcacaccttgctgccccccttacccctgcaccaccatcattgtctaccactgcgaactttccatctaggcaaagtcctggcaatcacttgatccacaggactcgcctcccagctccctcggggcccccagctacctagtttccttacctggatctcctgaggcccaccttcctccttcccactcccttacacatttgacttcctattggccctttgaaaaaccagctgagcagaatgccatgttctgaagcctggtgcccactactgatttattctcctttcaccttgttttcttcaaagggtagtagggcaaggccagactgcaaaaagaatagacactccccttttgaaatctgttcctctcccctccccttcctaccgcaccctcaggtctaaatccgaaaacttcaggcttttttaaacaatgagaaggaccattcacctgtctgctgaccagaaatgttgcccctaagttcttctccaagttctccttttctctccagagtgagaccagttttcctcagggacccaggacacaaagcccaaggcccagagtggctcagctgccccttacttcagcagtggactggccagccaaggcctggagggctggagccagaagcacctggaagggaaggggggctttaaactacctcaggttcctaatggcccggctgctacctctgcagacatggcctggactccttgacctctcactacctgccccaccttatcccaggacgtgttccttaccctcttgactttggccagcgctacaccaggtctgtctttgaactctttcaggtgcttgtcctgcctacacccaggtatctttcacagccagtgtggcaagcagaccacttagttggctgcatgcctgggtaggttggaagggcccacggcaccttcttctgcctatttagtcaaaggctgtttgctgtctcctcaactcaacctagtaaagctacccaggagggcaccacgtcgtgtgcatactgggtagtccatgtctgattgtaattgtttctttctggtgaaatgttacgggtaccagcagagtgatgattttggcccttgatggatctaaaactcggaacattactcctcaatgccgtttccccagttgctctgagaaggaagagacatgttcctcaggaaaagctccagctagcatgtttttcacgtcagtgggaagattcttgtgtgttcgtgtgtatctgtttatttctaagttcacgatacttgttcccctgaattttatttaaccaactagatcacattctttggccacaggtcagactctgagctgctttcctccagatcgggaaggagacacatatcacagatgccttctctaagacagctcctgtgtacagcatcgttctttgctgaggcctctatctgtccaattattatttttgaaattgcttttcaaattaaacattttacccgttgtgttgggtgtcaaaagaaattgctctctgatgaggcaagaacatgtctctccaacaacgtagtattgaacagagcaagttgttaatttgtggagtaggggaaaggttctgcaagttgccattgtacaaatccagttttacaaatgtttgcagcagattccacagacaaagagcccattcattgccgagagccctgcagaatctcagagcaaagtggctgtgtgttccgagccggagcctgacctgtggaccgtctttaatgtcttctgcaccagtccttttatgacgtgggctttttttaaacagggtaaagtgaatgtgttgcattgcaaactcaggtattatgaggagaaggtaggagtgtagctagcagcgtggagacattaggtcagccactagatgtatttgtgaatttggtttgaaggacacggagaaaggttggaggggaggttggtgtgtttgttttttgctttcttccccataatgtttggttaacaggtagcctttttgcgagtggaaggagagaaaagttgtgcatgttttctctaatttctctttctgccctctctctgatccccaaccaccaaaagcactcactttgagtgaggatttttttttttttttttttttttttgggggggggagtcccccttggggccccgggggggggtgcggggg

SEQ ID NO: 71988 - DNA, 4391 bp, Homo sapiens
  misc_feature (39)..(39): n is a, c, g, or t
ggcacgaggcggcgcggaggggcgcggagcggcgcgganccgggcggctcggggcccagagagagccgcggccgggagctcgcgggctcctgacaacctcctcccctcggcggacgacgaccacggcgactagggcgccggtcatggcggagcaacaaacccggcgcggaccctaggcaccaccgcatggagcgggacgaaccgccgcctagcggaggggtttctgtcaggatgaattggcagagcttgacccaggcactaatgatcgggctgaacaacgaacctgtctcatttgtggggaccgcgctacaggcttgcactatgggatcatctcctgtgagggctgcaaagggtttttcaagcggagcatttgcaacaaacgggtatatcgatgcagtcgtgacaagaactgtgtcatgtctcggaagcagaggaacaggtgccagtactgccgcctgctcaaatgcctccagatggggatgaaccggaaggctatcagagaagatggcatgcctggaggccggaataagagcattgggccagtccagatatcggaagaagaaatcgaaaggatcatgtctgggcaggagtttgaggaagaggccaatcactggagcaaccatggtgatagtgaccacagttcccctgggaacagggcttcggagagcaaccagccctcaccaggctccacactgtcttccagtaggtctgtggaactgaatggattcatggccttcagggaacagtacatgggaatgtctgtgcctccacattaccaatatataccgcacctttttagctattctggccactcaccacttctgccccaacaagctcgcagcctggatccccagtcatacagtctgattcaccagctgttatcagccgaggacctggaaccattgggcacgcccatgttgattgaagatggatacgctgtgacacaggcagaactatttgccctgctttgccgcctggccgacgagctgctctttaggcagattgcctggatcaagaaactgcctttcttctgcgagctctcaatcaaggattacacgtgcctcttgagctctacgtggcaggagctaatcctgctgtcttccctcaccgtttacagcaagcagatctttggggaactggctgatgtcactgccaagtactcgccctccgatgaagaactacacagatttagtgatgaagggatggaggtgatcgagcggctcatctacctctatcacaagttccatcagctaaaggtcagcaacgaggagtatgcttgcatgaaagcaattaacttcctaaatcaagatatcaggggtctgaccagtgcctcacagctggaacaattgaataaacgatactggtacatttgccaggattttactgaatataaatacacacatcagccgaaccgctttcctgatctcatgatgtgcttacctgagattcgatatattgcaggaaagatggtgaatgtgcccctggagcagctgcccctcctctttaaggtggtgctgcattcctgcaagaccagtgtgggcaaggaatgacctgttccaggcgccctcctcaggccaaccacagcgtcttgggtgggcaggacaggctctggagggaaaagccagagagaccaagatggaggctgtggagcagcatttcccgttgcctccatagcaagaagagtttttgtttgtttgtctgtttttttaacctcatttttctatatatttatttcacgacagagttgaatgtatggccttcaacatgatgcacatgcttttgtgtgaatgcagccaatgcattttcttacagtttacagaatgtgaagatgtttaatgttacagtgttgtcattgtttagaaatagttcttttgtattttgagggagagggtgggatggggctaagatgactatttccataatgttgacaaagatgactacctcaatggaaatggggggtgtggccatccctactttttccacattttctcagcagactcatacatttgtctgtcagagagcaaattgccaaaaaaagccacagaattgccagataaaatggcacactgtaagggcgcaaagtgttgttaggagattcactaagcaaggttggtgagacggcaacagggtaggaggtgaggattgagccacgtcctttccttggaaagcgtgaaaattaagagagtagggcacagtgaccatatttaaggcaggtgtccttccacccaacaagtcctaagggcagaagaatttctgttctcacaccttgctgccccccttacccctgcaccaccatcattgtctaccactgcgaactttccatctaggcaaagtcctggcaatcacttgatccacaggactcgcctcccagctccctcggggcccccagctacctagtttccttacctggatctcctgaggcccaccttcctccttcccactcccttacacatttgacttcctattggccctttgaaaaaccagctgagcagaatgccatgttctgaagcctggtgcccactactgatttattctcctttcaccttgttttcttcaaagggtagtagggcaaggccagactgcaaaaagaatagacactccccttttgaaatctgttcctctcccctccccttcctaccgcaccctcaggtctaaatccgaaaacttcaggcttttttaaacaatgagaaggaccattcacctgtctgctgaccagaaatgttgcccctaagttcttctccaagttctccttttctctccagagtgagaccagttttcctcagggacccaggacacaaagcccaaggcccagagtggctcagctgccccttacttcagcagtggactggccagccaaggcctggagggctggagccagaagcacctggaagggaaggggggctttaaactacctcaggttcctaatggcccggctgctacctctgcagacatggcctggactccttgacctctcactacctgccccaccttatcccaggacgtgttccttaccctcttgactttggccagcgctacaccaggtctgtctttgaactctttcaggtgcttgtcctgcctacacccaggtatctttcacagccagtgtggcaagcagaccacttagttggctgcatgcctgggtaggttggaagggcccacggcaccttcttctgcctatttagtcaaaggctgtttgctgtctcctcaactcaacctagtaaagctacccaggagggcaccacgtcgtgtgcatactgggtagtccatgtctgattgtaattgtttctttctggtgaaatgttacgggtaccagcagagtgatgattttggcccttgatggatctaaaactcggaacattactcctcaatgccgtttccccagttgctctgagaaggaagagacatgttcctcaggaaaagctccagctagcatgtttttcacgtcagtgggaagattcttgtgtgttcgtgtgtatctgtttatttctaagttcacgatacttgttcccctgaattttatttaaccaactagatcacattctttggccacaggtcagactctgagctgctttcctccagatcgggaaggagacacatatcacagatgccttctctaagacagctcctgtgtacagcatcgttctttgctgaggcctctatctgtccaattattatttttgaaattgcttttcaaattaaacattttacccgttgtgttgggtgtcaaaagaaattgctctctgatgaggcaagaacatgtctctccaacaacgtagtattgaacagagcaagttgttaatttgtggagtaggggaaaggttctgcaagttgccattgtacaaatccagttttacaaatgtttgcagcagattccacagacaaagagcccattcattgccgagagccctgcagaatctcagagcaaagtggctgtgtgttccgagccggagcctgacctgtggaccgtctttaatgtcttctgcaccagtccttttatgacgtgggctttttttaaacagggtaaagtgaatgtgttgcattgcaaactcaggtattatgaggagaaggtaggagtgtagctagcagcgtggagacattaggtcagccactagatgtatttgtgaatttggtttgaaggacacggagaaaggttggaggggaggttggtgtgtttgttttttgctttcttccccataatgtttggttaacaggtagcctttttgcgagtggaaggagagaaaagttgtgcatgttttctctaatttctctttctgccctctctctgatccccaaccaccaaaagcactcactttgagtgaggatttttttttttttttttttttttttgggggggggagtcccccttggggccccgggggggggtgcggggg

SEQ ID NO: 71989 - DNA, 4471 bp, Homo sapiens
cgggggctccagggcgccgacccagcatgggcagttgctcattgttggacataaggtcgcgctggtcatccatgactggcttctgatcttcccgacagctcctgcttctcctcctgtgcatctgggacgacgaccacggcgactagggcgccggtcatggcggagcaacaaacccggcgcggaccctaggcaccaccgcatggagcgggacgaaccgccgcctagcggagggggaggcggcgggggctcggcggggttcctggagcctcccgccgcgctccctccgccgccgcgcaacggtttctgtcaggatgaattggcagagcttgacccaggcactaatgatcgggctgaacaacgaacctgtctcatttgtggggaccgcgctacaggcttgcactatgggatcatctcctgtgagggctgcaaagggtttttcaagcggagcatttgcaacaaacgggtatatcgatgcagtcgtgacaagaactgtgtcatgtctcggaagcagaggaacaggtgccagtactgccgcctgctcaaatgcctccagatggggatgaaccggaaggctatcagagaagatggcatgcctggaggccggaataagagcattgggccagtccagatatcggaagaagaaatcgaaaggatcatgtctgggcaggagtttgaggaagaggccaatcactggagcaaccatggtgatagtgaccacagttcccctgggaacagggcttcggagagcaaccagccctcaccaggctccacactgtcttccagtaggtctgtggaactgaatggattcatggccttcagggaacagtacatgggaatgtctgtgcctccacattaccaatatataccgcacctttttagctattctggccactcaccacttctgccccaacaagctcgcagcctggatccccagtcatacagtctgattcaccagctgttatcagccgaggacctggaaccattgggcacgcccatgttgattgaagatggatacgctgtgacacaggcagaactatttgccctgctttgccgcctggccgacgagctgctctttaggcagattgcctggatcaagaaactgcctttcttctgcgagctctcaatcaaggattacacgtgcctcttgagctctacgtggcaggagctaatcctgctgtcttccctcaccgtttacagcaagcagatctttggggaactggctgatgtcactgccaagtactcgccctccgatgaagaactacacagatttagtgatgaagggatggaggtgatcgagcggctcatctacctctatcacaagttccatcagctaaaggtcagcaacgaggagtatgcttgcatgaaagcaattaacttcctaaatcaagatatcaggggtctgaccagtgcctcacagctggaacaattgaataaacgatactggtacatttgccaggattttactgaatataaatacacacatcagccgaaccgctttcctgatctcatgatgtgcttacctgagattcgatatattgcaggaaagatggtgaatgtgcccctggagcagctgcccctcctctttaaggtggtgctgcattcctgcaagaccagtgtgggcaaggaatgacctgttccaggcgccctcctcaggccaaccacagcgtcttgggtgggcaggacaggctctggagggaaaagccagagagaccaagatggaggctgtggagcagcatttcccgttgcctccatagcaagaagagtttttgtttgtttgtctgtttttttaacctcatttttctatatatttatttcacgacagagttgaatgtatggccttcaacatgatgcacatgcttttgtgtgaatgcagccaatgcattttcttacagtttacagaatgtgaagatgtttaatgttacagtgttgtcattgtttagaaatagttcttttgtattttgagggagagggtgggatggggctaagatgactatttccataatgttgacaaagatgactacctcaatggaaatggggggtgtggccatccctactttttccacattttctcagcagactcatacatttgtctgtcagagagcaaattgccaaaaaaagccacagaattgccagataaaatggcacactgtaagggcgcaaagtgttgttaggagattcactaagcaaggttggtgagacggcaacagggtaggaggtgaggattgagccacgtcctttccttggaaagcgtgaaaattaagagagtagggcacagtgaccatatttaaggcaggtgtccttccacccaacaagtcctaagggcagaagaatttctgttctcacaccttgctgccccccttacccctgcaccaccatcattgtctaccactgcgaactttccatctaggcaaagtcctggcaatcacttgatccacaggactcgcctcccagctccctcggggcccccagctacctagtttccttacctggatctcctgaggcccaccttcctccttcccactcccttacacatttgacttcctattggccctttgaaaaaccagctgagcagaatgccatgttctgaagcctggtgcccactactgatttattctcctttcaccttgttttcttcaaagggtagtagggcaaggccagactgcaaaaagaatagacactccccttttgaaatctgttcctctcccctccccttcctaccgcaccctcaggtctaaatccgaaaacttcaggcttttttaaacaatgagaaggaccattcacctgtctgctgaccagaaatgttgcccctaagttcttctccaagttctccttttctctccagagtgagaccagttttcctcagggacccaggacacaaagcccaaggcccagagtggctcagctgccccttacttcagcagtggactggccagccaaggcctggagggctggagccagaagcacctggaagggaaggggggctttaaactacctcaggttcctaatggcccggctgctacctctgcagacatggcctggactccttgacctctcactacctgccccaccttatcccaggacgtgttccttaccctcttgactttggccagcgctacaccaggtctgtctttgaactctttcaggtgcttgtcctgcctacacccaggtatctttcacagccagtgtggcaagcagaccacttagttggctgcatgcctgggtaggttggaagggcccacggcaccttcttctgcctatttagtcaaaggctgtttgctgtctcctcaactcaacctagtaaagctacccaggagggcaccacgtcgtgtgcatactgggtagtccatgtctgattgtaattgtttctttctggtgaaatgttacgggtaccagcagagtgatgattttggcccttgatggatctaaaactcggaacattactcctcaatgccgtttccccagttgctctgagaaggaagagacatgttcctcaggaaaagctccagctagcatgtttttcacgtcagtgggaagattcttgtgtgttcgtgtgtatctgtttatttctaagttcacgatacttgttcccctgaattttatttaaccaactagatcacattctttggccacaggtcagactctgagctgctttcctccagatcgggaaggagacacatatcacagatgccttctctaagacagctcctgtgtacagcatcgttctttgctgaggcctctatctgtccaattattatttttgaaattgcttttcaaattaaacattttacccgttgtgttgggtgtcaaaagaaattgctctctgatgaggcaagaacatgtctctccaacaacgtagtattgaacagagcaagttgttaatttgtggagtaggggaaaggttctgcaagttgccattgtacaaatccagttttacaaatgtttgcagcagattccacagacaaagagcccattcattgccgagagccctgcagaatctcagagcaaagtggctgtgtgttccgagccggagcctgacctgtggaccgtctttaatgtcttctgcaccagtccttttatgacgtgggctttttttaaacagggtaaagtgaatgtgttgcattgcaaactcaggtattatgaggagaaggtaggagtgtagctagcagcgtggagacattaggtcagccactagatgtatttgtgaatttggtttgaaggacacggagaaaggttggaggggaggttggtgtgtttgttttttgctttcttccccataatgtttggttaacaggtagcctttttgcgagtggaaggagagaaaagttgtgcatgttttctctaatttctctttctgccctctctctgatccccaaccaccaaaagcactcactttgagtgaggatttttttttttttttttttttttttgggggggggagtcccccttggggccccgggggggggtgcggggg

SEQ ID NO: 71990 - DNA, 4202 bp, Homo sapiens
catggctgcaatagaacttttcagcagactacaagaagcatgaaatggagacatgggaagtttctgtttcagatgatcgggctgaacaacgaacctgtctcatttgtggggaccgcgctacaggcttgcactatgggatcatctcctgtgagggctgcaaagggtttttcaagcggagcatttgcaacaaacgggtatatcgatgcagtcgtgacaagaactgtgtcatgtctcggaagcagaggaacaggtgccagtactgccgcctgctcaaatgcctccagatggggatgaaccggaaggctatcagagaagatggcatgcctggaggccggaataagagcattgggccagtccagatatcggaagaagaaatcgaaaggatcatgtctgggcaggagtttgaggaagaggccaatcactggagcaaccatggtgatagtgaccacagttcccctgggaacagggcttcggagagcaaccagccctcaccaggctccacactgtcttccagtaggtctgtggaactgaatggattcatggccttcagggaacagtacatgggaatgtctgtgcctccacattaccaatatataccgcacctttttagctattctggccactcaccacttctgccccaacaagctcgcagcctggatccccagtcatacagtctgattcaccagctgttatcagccgaggacctggaaccattgggcacgcccatgttgattgaagatggatacgctgtgacacaggcagaactatttgccctgctttgccgcctggccgacgagctgctctttaggcagattgcctggatcaagaaactgcctttcttctgcgagctctcaatcaaggattacacgtgcctcttgagctctacgtggcaggagctaatcctgctgtcttccctcaccgtttacagcaagcagatctttggggaactggctgatgtcactgccaagtactcgccctccgatgaagaactacacagatttagtgatgaagggatggaggtgatcgagcggctcatctacctctatcacaagttccatcagctaaaggtcagcaacgaggagtatgcttgcatgaaagcaattaacttcctaaatcaagatatcaggggtctgaccagtgcctcacagctggaacaattgaataaacgatactggtacatttgccaggattttactgaatataaatacacacatcagccgaaccgctttcctgatctcatgatgtgcttacctgagattcgatatattgcaggaaagatggtgaatgtgcccctggagcagctgcccctcctctttaaggtggtgctgcattcctgcaagaccagtgtgggcaaggaatgacctgttccaggcgccctcctcaggccaaccacagcgtcttgggtgggcaggacaggctctggagggaaaagccagagagaccaagatggaggctgtggagcagcatttcccgttgcctccatagcaagaagagtttttgtttgtttgtctgtttttttaacctcatttttctatatatttatttcacgacagagttgaatgtatggccttcaacatgatgcacatgcttttgtgtgaatgcagccaatgcattttcttacagtttacagaatgtgaagatgtttaatgttacagtgttgtcattgtttagaaatagttcttttgtattttgagggagagggtgggatggggctaagatgactatttccataatgttgacaaagatgactacctcaatggaaatggggggtgtggccatccctactttttccacattttctcagcagactcatacatttgtctgtcagagagcaaattgccaaaaaaagccacagaattgccagataaaatggcacactgtaagggcgcaaagtgttgttaggagattcactaagcaaggttggtgagacggcaacagggtaggaggtgaggattgagccacgtcctttccttggaaagcgtgaaaattaagagagtagggcacagtgaccatatttaaggcaggtgtccttccacccaacaagtcctaagggcagaagaatttctgttctcacaccttgctgccccccttacccctgcaccaccatcattgtctaccactgcgaactttccatctaggcaaagtcctggcaatcacttgatccacaggactcgcctcccagctccctcggggcccccagctacctagtttccttacctggatctcctgaggcccaccttcctccttcccactcccttacacatttgacttcctattggccctttgaaaaaccagctgagcagaatgccatgttctgaagcctggtgcccactactgatttattctcctttcaccttgttttcttcaaagggtagtagggcaaggccagactgcaaaaagaatagacactccccttttgaaatctgttcctctcccctccccttcctaccgcaccctcaggtctaaatccgaaaacttcaggcttttttaaacaatgagaaggaccattcacctgtctgctgaccagaaatgttgcccctaagttcttctccaagttctccttttctctccagagtgagaccagttttcctcagggacccaggacacaaagcccaaggcccagagtggctcagctgccccttacttcagcagtggactggccagccaaggcctggagggctggagccagaagcacctggaagggaaggggggctttaaactacctcaggttcctaatggcccggctgctacctctgcagacatggcctggactccttgacctctcactacctgccccaccttatcccaggacgtgttccttaccctcttgactttggccagcgctacaccaggtctgtctttgaactctttcaggtgcttgtcctgcctacacccaggtatctttcacagccagtgtggcaagcagaccacttagttggctgcatgcctgggtaggttggaagggcccacggcaccttcttctgcctatttagtcaaaggctgtttgctgtctcctcaactcaacctagtaaagctacccaggagggcaccacgtcgtgtgcatactgggtagtccatgtctgattgtaattgtttctttctggtgaaatgttacgggtaccagcagagtgatgattttggcccttgatggatctaaaactcggaacattactcctcaatgccgtttccccagttgctctgagaaggaagagacatgttcctcaggaaaagctccagctagcatgtttttcacgtcagtgggaagattcttgtgtgttcgtgtgtatctgtttatttctaagttcacgatacttgttcccctgaattttatttaaccaactagatcacattctttggccacaggtcagactctgagctgctttcctccagatcgggaaggagacacatatcacagatgccttctctaagacagctcctgtgtacagcatcgttctttgctgaggcctctatctgtccaattattatttttgaaattgcttttcaaattaaacattttacccgttgtgttgggtgtcaaaagaaattgctctctgatgaggcaagaacatgtctctccaacaacgtagtattgaacagagcaagttgttaatttgtggagtaggggaaaggttctgcaagttgccattgtacaaatccagttttacaaatgtttgcagcagattccacagacaaagagcccattcattgccgagagccctgcagaatctcagagcaaagtggctgtgtgttccgagccggagcctgacctgtggaccgtctttaatgtcttctgcaccagtccttttatgacgtgggctttttttaaacagggtaaagtgaatgtgttgcattgcaaactcaggtattatgaggagaaggtaggagtgtagctagcagcgtggagacattaggtcagccactagatgtatttgtgaatttggtttgaaggacacggagaaaggttggaggggaggttggtgtgtttgttttttgctttcttccccataatgtttggttaacaggtagcctttttgcgagtggaaggagagaaaagttgtgcatgttttctctaatttctctttctgccctctctctgatccccaaccaccaaaagcactcactttgagtgaggatttttttttttttttttttttttttgggggggggagtcccccttggggccccgggggggggtgcggggg

SEQ ID NO: 71991 - DNA, 1765 bp, Homo sapiens
agggaactcctgctcctgccgggccagccacagacccccgtcttccccagcacccatgacccccggacggtgaccctggacttccggaacgcggggatcccagcccctccaccaccccttcccccccagccacccccacccccacctcccccacctgtagagcccaccaagctgccctttaaggagctagacaaccagtggccctccgaggccattcctccgggcccccgtgggcgcgatgaggtcactgaggaatacatggagttggccaagagccgggggccgtggcgccggccacctaagaagcgccatgaggacctggtgccacctgcgggctcgcccgaactctcgccaccccagcccctcttccggccccgctcggagtttgaggagatgaccatcctgtatgacatctggaacggtggcatcgatgaggaggacatccgcttcctgtgtgtcacctacgagcgactgctacagcaggacaatggcatggactggcttaacgacacgctctgggtctaccatccctatatcctgctggcatggggggctctgcaccttctgggatgcaggaagtccctgctcacctctctgggccccaccacccagtctgtagcagcccgcggtgcccatgaaggtgacagcatgcaccaccgtcacttcccaagcagggtttgtgtcccggcaccatgccaggctcccgagtgaatcattggcacgttttaaggactccctctgcgccaggcccatctcacccccagagttagcaggtctcagggtcacatgtaacagcagtgccgtgcagcttaacagcacacacgggcgcagggcctccttgtcctgtccccttcataacctcaggtaatcccagtagcctggtgaagatgggggctatgattcccattttacatatgaagaagctaaggctcagagaggttcagtgacctgtccaaagacacagctacaggtggcagagttgagatttgaacccaggcaaacctggctctagagtccaggctcttcaccaccaggctttcatgaggcttggctgttcacataggccagtgaggctagacctctcattatccctgctgtattagactgatttgtgagcactcagtttgtgtcaagagctctgctcaagtgccgggcaccatggctcacagctgtaatcccagcactatgggaggctgaggcggacggatcactcgaggccagaagtttgagaccagcctggccaacatggcaaaaccccatttctactaaaaatacaaaaattagccgggtgtggtagcacatgcctataattccagctactctggaggctgaggcaggagaattgcttgaacccgggaggcacaggttgtagtgagccaagatcgcaccactgcactccagcctgggtgacagaacaagactctgtctcaaaaaaaaaacaaaactctgctaaggaccataagcatatttcatcacttgcagagaggcatcactgtcaccccaatttacagatgggaaactgagcagaaagttgttaaaacacccagcactttgggaggccgaggtggatggatcacttgatctctggaggttgaagccagcctgggaaacatagcaaaaccccatctctacaaaaaaaatccagaaattagttgggtgtggtggcgcacgcctgtagccccagctgctcagaaggctgaggctgcagtaagctgagattgcaccactgcactcgagcctgggcaacaggagaccctgtctcaaa

SEQ ID NO: 71992 - DNA, 724 bp, Homo sapiens
agggaactcctgctcctgccgggccagccacagacccccgtcttccccagcacccatgacccccggacggtgaccctggacttccggaacgcggggatcccagcccctccaccaccccttcccccccagccacccccacccccacctcccccacctgtagagcccaccaagctgccctttaaggagctagacaaccagtggccctccgaggccattcctccgggcccccgtgggcgcgatgaggtcactgaggaatacatggagttggccaagagccgggggccgtggcgccggccacctaagaagcgccatgaggacctggtgccacctgcgggctcgcccgaactctcgccaccccagcccctcttccggccccgctcggagtttgaggagatgaccatcctgtatgacatctggaacggtggcatcgatgaggaggacatccgcttcctgtgtgtcacctacgagcgactgctacagcaggacaatggcatggactggcttaacgacacgctctgggtctaccatccctccaccagcctctcttcagctaagaagaagaaacgggacgatggcatccgcgagcacgtgacgggctgtgcccgcagtgagggcttctacaccatcgacaagaaggacaagctcagatacctcaacagcagccgtgccagcaccgatgagcccacaatgtatgggtactttgaacccggaagaagaaaatgat

SEQ ID NO: 71993 - DNA, 1198 bp, Homo sapiens
tctgaattaattaggtattggtaaaatatatttttaaatttagttagctttataaacacaattagaattacaattaattaacagaggtataattgtctcactttcagaagtgatcatttatttttatttagcacaggtcataagaaaaatatatagaaaaataatcaatttcatatataaaaggattatttctccacctttaattattggcctatcatttgttagtgttatttggtcatattattgaactaatgtattattccattcaaagtctttctagatttaaaaatgtatgcaaaagcttaggattatatcatgtgtaactattatagataacatcctaaaccttcagtttagatatataattgactgggtgtaatctcttttgtaatctgttttgacagatttcttaaattatgttagcataatcaaggaagatttaccttgaagcactttccaaattgatactttcaaacttattttaaagcagtagaaccttttctatgaactaaatcacatgcaaaactccaacctgtagtatacataaaatggacttacttattcctctcaccttctccagtgcctaggaatattcttctctgagccctaggattgattctatcacacagagcaacattaatctaaatggtttagctccctcttttttctctaaaaacaatcagctaataaaaaaaaaatttgagggcctaaattatttcaatggttgtttgaaatattcagttcagtttgtacctgttagcagtctttcagtttgggggagaattaaatactgtgctaagctggtgcttggatacatattacagcatcttgtgttttatttgacaaacagaattttggtgccataatattttgagaattagagaagattgtgatgcatatatataaacactatttttaaaaaatatctaaatatgtctcacatatttatataatcctcaaatatactgtaccattttagatattttttaaacagattaatttggagaagttttattcattacctaattctgtggcaaaaatggtgcctctgatgttgtgatatagtattgtcagtgtgtacatatataaaacctgtgtaaacctctgtccttatgaaccataacaaatgtagctttttaaagtccattgtattgttttttctttcaataaaagagtataattaattggttgtttttga

SEQ ID NO: 71994 - DNA, 739 bp, Homo sapiens
aagagcagggagaaggcacaggtgtggagatcccaggactggtacagtgggtcttgttggagaaatgcttcatgcggctagaaaacgagatcacgttcctttcagaaaaatgtcactcataatgaaagaaatgcactggagaacccaacacccaacttttccctctcatatcattaaaaggtgaaatctcttattgccggcaagagtgtatggtgatgacactctcaggccctgctggtgttggaaaaaccatttgtggcaatgccacttcctaagaaaaacgtatcaatcatttgcaatgttcaccattgataaaaaaagagatatgcaatcagtgaaatgcataacattgataatctgcctacattaatgtgcttttgtttactgtatgtaatacacgcttattaaaaaaatttcaaaaaatactaaaatgtacaaaaaaaaaaaaaaaaccaaaacatttataatcccgctgagagataaccactgttagtctttaagtgcttaaaaatgtatttgaaggtattatgggtgtatatatattaaagcttattctttaagagaaacgcacactcattaaagtataaagaaaaattgtccagaatacctaccagaaaaactgctaatattttgatatgtaattagtttaaaaaaaatatttgaggctgggcgcagtggctcacacctgtaatctcggagctttgtgaggctgaaccaggaggatttcttgaggccagga

SEQ ID NO: 71995 - DNA, 437 bp, Homo sapiens
caaggctgcagggggctgtgacagcaccactacactccagcctgggccacagagtgagaccctgtctcaaaaacaaaacaaaactatgaactatgactccattaaaatttaaaattaataatgagatttacagttacagcaaagaatgtaaaaatgaaaaacaagcttcacaatttaaaataatataactaatgggctgggacaaaaatcctagagcttgttgacaactcagtaggggctgagcggccagtgtaagtgagctaatttccttgtctttcacagcaagaagtcaatattcactttgttttttaaagttaatcaaaatattaaaagtttttaaagtttatcctttaaaatacaaaagtggccaggtggagtggtatgtgcctgtagtcctaactacttgggaggcagaggtgggaggatcacttgagccc

SEQ ID NO: 71996 - DNA, 547 bp, Homo sapiens
tttcctagtaaaggatgtatttcactcatggtactgtaatgataaatcccattttcaggttaagactgcatctggagtattgaaacttggagccactttctaagagggtaaataggaggataagaagtctttaaccatttctattgaggataggctgctgtaattactgtggaaaagagaaggcttactggggggctatgagaaggcagaagtagaacatttgttctacttgggtgatgaattagaagtggaaaaagatgagaggcaaagacaaagacagctcctagaattgaagcctcttacaccaagcatggtgtaagttgccgtgcaaagaagtgagttcccaaacgctgtgagtactttagcagaggtggctccataccagggactaaggattcctgcttgggataaaagagtagaagactcttgagcaactttctgatggataatttgtggggaaagtattccttgatatattctttctaactaggtataaagaattggagccactatttgttgattttagaaatagtcaaagaaaaaaaaa

SEQ ID NO: 71997 - DNA, 260 bp, Homo sapiens
tgataagaagcgaattcagggctttttctttagactataagtggttattagaaataaattatcctcatattgaactccaattgtcatgttttcccttccctgtgtctttcaagtagttaaaaagcttgttaacatgaaagtagaataattaaagtaaaatccttgccaaatgtttctaaaataaaagcagccatgttctcatttcagttttgttcaagtaatcattttaatgtcagtagctataaaaaggggagaagtac

SEQ ID NO: 71998 - DNA, 405 bp, Homo sapiens
taccttcaatatttactgggcttttttttttttctccatagatgcccaagtagctcttaccttaaaagccagtaaatattgaaggtacaagaaagagaggaggggaaaacctgagtagaaaaatggtggcatccagggggtgcacaatttttgcaaggggagtgaaggaacgaatgaactgcagaaagactcacttgatataaaggcggcttcaggagcccttatgctaattggctccagtagttttataatgaataaaatagtctttgagctaagggcaataccactccttcatatgcacaggatcttggacctctgttttctttggactctgaggtatttttcacttatttccaggttcctggttgtggttgttggaattctgcctgccagattagaggggag

SEQ ID NO: 71999 - DNA, 836 bp, Homo sapiens
cactggggccgctgagtggaccactgtagaaagcaatggttcttgtttcttattttttacattattttcagggatgtgtgtcccatcaaagtctcattatggaggagttgaattttcccgggacacctgtggcagggctgccagacaccagcctaaactgctctcactctcatttccagaccaagggcctctggcggcctgtagggagccatgggcaatcacagcaaccctctctgaggccaaggaagttcaggtatgagctgtacctgaggctgccctggcctctcctctcccgtcagtcctcactgggtgtcttctcaccctgccctctgccagctccactgctttccctgctgggtttcattgcttgtgcaaggaagatacggaagccacacaatgggttggttctttctagcccttcccagactgactataggccagcggggtctgtatctagaaatcttttattactctaagttgaacagtttaatgattagtcattttaatttagagttgagattccattagtatttgactgtggccttcttattgagaactctgttcaactttgaaatgccaaagcaggagcctttgttctttgatcctgccgtgagttaagaaattctgtatttcttcagaagtgtttcattttgtgtaatgaagtcaagggttagagtgactcagtgttccatgagttaagtgtctttgtagaatgaacagtaaacttatctcctaataattctgcgttaattacaattacactgcctgtctctggggatcatcagaaaaagatactgtttcttaatttattcctaaggcttaaaaaaaaaagttag

SEQ ID NO: 72000 - DNA, 428 bp, Homo sapiens
ttcacagttatagttggggacattaacaaccctttctcaataattgatagactactaaataaaaaaccatgaaggatatacaagaactgtacaacactggccgggtgtggtggctcatgcctgtaatcccagcactttgggaggctgaggcgggtggatcacttgaggtcaggagttcgagaccagcctagccaacatggcgaaaccacatctctactaaaaatacaaaaaaattaggctggctgtggttggcttaatgcctgtaatcccagcactttgggaggccaaggtgggcatatcacctgaggtcaggagtttgagaccagcctgaaaaacatggtgaaacccatctctactaaaaatacaaaaattagctgggtgtggtgcgtctgaaaaaataagtaaactccgtctcaaaaaataaataa

SEQ ID NO: 72001 - DNA, 455 bp, Homo sapiens
aagggtaggaggaaaggcaaagcaagctgcacaaagggaagatggcccgtagccttgaaatgcactcttgctagccctccccattttggttattatcagcaaagatcagtgacatgttaatatattcggctattttactgtgaatataatggtaaattttaatagaaattgagttagatagcagtttctgaatctgaaagaaagtgacattgcttgcgaatgctcacagtagcacttaacattgtgaagttcaactcaatttttatttgctgtttcacagaaagcaataatccctcatattttatagtaccatctggggttacaaaaatcccgatgcgtctttgttgggacaagccgggatctcagggaagggagtgggagggggagcttcatcttcagtgggctttctgccctggaatttggaatttttttaaccagggcaggctttttaaggc

SEQ ID NO: 72002 - DNA, 466 bp, Homo sapiens
ggtaagatattgtgaataattttttattattaaaaattttttttaggtagcatgtaatccacataaataaaaaactcaagaataaactgggacagaggatttcttccagagtgctacatggcaaaagagccttcaggaacgtgtgcaggggtgtcatgatactccgaaggtgtcagtagttttggtcagcccacagtgagcagggcagcctcaagggagagccccttacatccttttctgggcacctctgtctaattaagttcaaacatacaagcctgattctaggattaaggcataagttagttctgaacagaaaaatataaggcagttcacatacacaatgaattcttgaagaaagaacctatagcccccagaccgataataaataattactgcctgccaaaatcctgaagaaagggaagcatgggggctccaaaattaatagtctcctgagaatacttatgag

SEQ ID NO: 72003 - DNA, 346 bp, Homo sapiens
ccaagttttggcttttctgaattcttttcattcttgccgaattggcaatgcatttaaaaaggtttagacatttagccaggcatggtgtctcatggctgtaattccagcactttgagaggccaagatggggggattgcttgagaccaggagttcaagaccagcctgggcaacacagagagacccccatccctccacaacatttaaaaaaattagccggttgtagtggtgcacacctgtaatcctagctactaaggaggctggggcaggaggattgcttaagcctagaagttgcagtgagctatgatcatgccacaacctgggtgacagagggaggccctgtttctaa

SEQ ID NO: 72004 - DNA, 572 bp, Homo sapiens
ctagatccacagccccaaaatcttaactagagatgtatttcctaagttgaaatttagtaatgggggtcattcattgcagagttctgctaaaaattggcagtaactatacataattgttttttccttagttttctgttaagcatctgctgtgtgcaggatgcttctgcagaaatccttaagtctctgtaagcttattagttttgaagtaagttataggacaaactcttgagatgaaataaatgtgtacacagacccctctaaaactgttttcagcctttgcactattgacatcttggaccagataattctttgtaatggggagatgtttagcagcatcgctggcttctacccagtagagatagtaacactccacttccctcagtcatgacagtaaaaatgtctccagacattgccaaatatcttttgggggacaaaatcacccaggaaagaaccacccttctagaacttcaaggacccaattaacatcaatcttcagaaaagatagatatttaaagctcttgtaattatgattgccgaagtactggtttaggctttttgaatttttaaatata

SEQ ID NO: 72005 - DNA, 1927 bp, Homo sapiens
  misc_feature (1735)..(1735): n is a, c, g, or t
  misc_feature (1744)..(1744): n is a, c, g, or t
  misc_feature (1753)..(1753): n is a, c, g, or t
  misc_feature (1764)..(1764): n is a, c, g, or t
  misc_feature (1767)..(1767): n is a, c, g, or t
  misc_feature (1790)..(1790): n is a, c, g, or t
  misc_feature (1800)..(1800): n is a, c, g, or t
  misc_feature (1805)..(1805): n is a, c, g, or t
  misc_feature (1842)..(1843): n is a, c, g, or t
  misc_feature (1848)..(1848): n is a, c, g, or t
  misc_feature (1854)..(1854): n is a, c, g, or t
  misc_feature (1877)..(1877): n is a, c, g, or t
  misc_feature (1887)..(1887): n is a, c, g, or t
  misc_feature (1890)..(1890): n is a, c, g, or t
  misc_feature (1892)..(1892): n is a, c, g, or t
  misc_feature (1907)..(1907): n is a, c, g, or t
  misc_feature (1909)..(1909): n is a, c, g, or t
  misc_feature (1915)..(1915): n is a, c, g, or t
agctggagcgttcggtggacagtgagcatgcgtaccatatctgaagttcgtaaattgaaattgaacatgcgtaattaatctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcggttgtttttagaggtaatacacctagtttgtggctcagcatgtcaattgtaacagtgcaacttggtcagtgtggcaatcagattggttttgaagtttttgatgctttgcttagtgactcacacagttcccagggactctgctctatgagagagaatgaggcatatcaagcatcttgcaaagaaagattcttcagtgaggaggagaatggagttccaattgcccgggctgttcttgttgacatggaacccaaagttatcaatcaaacgctgtcaaaggctgcccagtctggccaatggaaatatggtcaacatgcatgcttctgtcaaaaacaaggttctggaaacaactgggcatatggttactctgttcatggacccaggcatgaagaatctataatgaacataatccggaaggaagtggagaaatgtgactctttcagtggttttttcatcataatgagtatggctgggggcacaggatcaggattaggagctttcgttacacagaatttagaagatcagtactcaaactcattgaaaatgaatcagattatttggccttatggaactggtgaggttattgttcaaaactacaactccattttgacactttctcacttgtaccgatcttcagacgccctccttcttcatgagaatgatgccatccataagatctgtgcaaaactgatgaatatcaagcagatctcctttagtgatatcaatcaagtcctcgcacatcagctgggaagtgtgttccagcctacttattctgcagaaagctcatttcactacagacgaaatccactaggagacttaatggagcatttagttccccatcctgaattcaagatgctgagtgttcgtaacattcctcacatgtctgagaattcattggcatacaccacatttacttgggctggcctcctcaagcatttgagacagatgctcatttctaatgcaaagatggaagaaggtattgataggcatgtatggcctcctttatcaggacttcctcctcttagtaaaatgtctctcaacaaggacctgcattttaacacttccattgctaacttggtcattcttcgtgggaaagatgtgcaaagtgcagatgtggagggatttaaagatccagctctgtatacttcctggttgaagcctgttaatgctttcaacgtgtggaaaacccagcgggcctttagcaaatatgagaagtctgcagtgttggtcagcaacagccagttcttagtaaaaccacttgatatgattgttgggaaggcatggaatatgtttgcttcaaaagcctacattcatcagtacacaaaatttggaatcgaagaagaggactttttagacagtttcacgtcattagagcaggttgttgccagttactgtaatctctgatcttgaacaatgggaaaagtataccttaaggcatttctggactaaaatattttcaatactattttctctgtaaagttttcaaagttctccatccnggctaacanggtgaaacnccgtctctacnaanaatacaaaaaattagccaggcgnggtggcgggngcctntagtcccagctactcgggaggctgaggcaggagaatnncgtgnacccangaggcggagcttgcagtgagccnagatcgcgcnacngnactccagcctgggcnanagagcnagactccgtctc

SEQ ID NO: 72006 - DNA, 235 bp, Homo sapiens
ctttcgatgtttttgggtttttttccccctctagttccaattgcccgggctgttcttgttgacatggaacccaaagttatcaatcaaacgctgtcaaaggctgcccagtctggccaatggaaatatggtcaacatgcatgcttctgtcaaaaacaaggttctggaaacaactgggcatatgggtaagaataatttcttgtgattttcagtttagtgacagctacacagtcaatta

SEQ ID NO: 72007 - DNA, 1827 bp, Homo sapiens
  misc_feature (1635)..(1635): n is a, c, g, or t
  misc_feature (1644)..(1644): n is a, c, g, or t
  misc_feature (1653)..(1653): n is a, c, g, or t
  misc_feature (1664)..(1664): n is a, c, g, or t
  misc_feature (1667)..(1667): n is a, c, g, or t
  misc_feature (1690)..(1690): n is a, c, g, or t
  misc_feature (1700)..(1700): n is a, c, g, or t
  misc_feature (1705)..(1705): n is a, c, g, or t
  misc_feature (1742)..(1743): n is a, c, g, or t
  misc_feature (1748)..(1748): n is a, c, g, or t
  misc_feature (1754)..(1754): n is a, c, g, or t
  misc_feature (1777)..(1777): n is a, c, g, or t
  misc_feature (1787)..(1787): n is a, c, g, or t
  misc_feature (1790)..(1790): n is a, c, g, or t
  misc_feature (1792)..(1792): n is a, c, g, or t
  misc_feature (1807)..(1807): n is a, c, g, or t
  misc_feature (1809)..(1809): n is a, c, g, or t
  misc_feature (1815)..(1815): n is a, c, g, or t
agctggagcgttcggtggacagtgagcatgcgtaccatatctgaagttcgtaaattgaaattgaacatgcgtaattaatctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcggttgtttttagagtgactcacacagttcccagggactctgctctatgagagagaatgaggcatatcaagcatcttgcaaagaaagattcttcagtgaggaggagaatggagttccaattgcccgggctgttcttgttgacatggaacccaaagttatcaatcaaacgctgtcaaaggctgcccagtctggccaatggaaatatggtcaacatgcatgcttctgtcaaaaacaaggttctggaaacaactgggcatatggttactctgttcatggacccaggcatgaagaatctataatgaacataatccggaaggaagtggagaaatgtgactctttcagtggttttttcatcataatgagtatggctgggggcacaggatcaggattaggagctttcgttacacagaatttagaagatcagtactcaaactcattgaaaatgaatcagattatttggccttatggaactggtgaggttattgttcaaaactacaactccattttgacactttctcacttgtaccgatcttcagacgccctccttcttcatgagaatgatgccatccataagatctgtgcaaaactgatgaatatcaagcagatctcctttagtgatatcaatcaagtcctcgcacatcagctgggaagtgtgttccagcctacttattctgcagaaagctcatttcactacagacgaaatccactaggagacttaatggagcatttagttccccatcctgaattcaagatgctgagtgttcgtaacattcctcacatgtctgagaattcattggcatacaccacatttacttgggctggcctcctcaagcatttgagacagatgctcatttctaatgcaaagatggaagaaggtattgataggcatgtatggcctcctttatcaggacttcctcctcttagtaaaatgtctctcaacaaggacctgcattttaacacttccattgctaacttggtcattcttcgtgggaaagatgtgcaaagtgcagatgtggagggatttaaagatccagctctgtatacttcctggttgaagcctgttaatgctttcaacgtgtggaaaacccagcgggcctttagcaaatatgagaagtctgcagtgttggtcagcaacagccagttcttagtaaaaccacttgatatgattgttgggaaggcatggaatatgtttgcttcaaaagcctacattcatcagtacacaaaatttggaatcgaagaagaggactttttagacagtttcacgtcattagagcaggttgttgccagttactgtaatctctgatcttgaacaatgggaaaagtataccttaaggcatttctggactaaaatattttcaatactattttctctgtaaagttttcaaagttctccatccnggctaacanggtgaaacnccgtctctacnaanaatacaaaaaattagccaggcgnggtggcgggngcctntagtcccagctactcgggaggctgaggcaggagaatnncgtgnacccangaggcggagcttgcagtgagccnagatcgcgcnacngnactccagcctgggcnanagagcnagactccgtctc

SEQ ID NO: 72008 - DNA, 1823 bp, Homo sapiens
  misc_feature (1631)..(1631): n is a, c, g, or t
  misc_feature (1640)..(1640): n is a, c, g, or t
  misc_feature (1649)..(1649): n is a, c, g, or t
  misc_feature (1660)..(1660): n is a, c, g, or t
  misc_feature (1663)..(1663): n is a, c, g, or t
  misc_feature (1686)..(1686): n is a, c, g, or t
  misc_feature (1696)..(1696): n is a, c, g, or t
  misc_feature (1701)..(1701): n is a, c, g, or t
  misc_feature (1738)..(1739): n is a, c, g, or t
  misc_feature (1744)..(1744): n is a, c, g, or t
  misc_feature (1750)..(1750): n is a, c, g, or t
  misc_feature (1773)..(1773): n is a, c, g, or t
  misc_feature (1783)..(1783): n is a, c, g, or t
  misc_feature (1786)..(1786): n is a, c, g, or t
  misc_feature (1788)..(1788): n is a, c, g, or t
  misc_feature (1803)..(1803): n is a, c, g, or t
  misc_feature (1805)..(1805): n is a, c, g, or t
  misc_feature (1811)..(1811): n is a, c, g, or t
agctggagcgttcggtggacagtgagcatgcgtaccatatctgaagttcgtaaattgaaattgaacatgcgtaattaatctttctgaataggaaaaaatatatacacaacaaaactctccgtttatggaacatgcgcatttgttctcagtaagtttttcgttttgaaagtgagcatgcgcatggtgagtaggttggtccgaagtttgaaccggacagaagcgctggtcggcgtctggcggttgtttttagttccaattgcccgggctgttcttgttgacatggaacccaaagttatcaatcaaacgctgtcaaaggctgcccagtctggccaatggaaatatggtcaacatgcatgcttctgtcaaaaacaaggttctggaaacaactgggcatatggtagagacaaggattcagcatgttacccagactggtctggaactcctggcctccagtgatccacctgcctcggcctcccaaagtgctgagattacagttactctgttcatggacccaggcatgaagaatctataatgaacataatccggaaggaagtggagaaatgtgactctttcagtggttttttcatcataatgagtatggctgggggcacaggatcaggattaggagctttcgttacacagaatttagaagatcagtactcaaactcattgaaaatgaatcagattatttggccttatggaactggtgaggttattgttcaaaactacaactccattttgacactttctcacttgtaccgatcttcagacgccctccttcttcatgagaatgatgccatccataagatctgtgcaaaactgatgaatatcaagcagatctcctttagtgatatcaatcaagtcctcgcacatcagctgggaagtgtgttccagcctacttattctgcagaaagctcatttcactacagacgaaatccactaggagacttaatggagcatttagttccccatcctgaattcaagatgctgagtgttcgtaacattcctcacatgtctgagaattcattggcatacaccacatttacttgggctggcctcctcaagcatttgagacagatgctcatttctaatgcaaagatggaagaaggtattgataggcatgtatggcctcctttatcaggacttcctcctcttagtaaaatgtctctcaacaaggacctgcattttaacacttccattgctaacttggtcattcttcgtgggaaagatgtgcaaagtgcagatgtggagggatttaaagatccagctctgtatacttcctggttgaagcctgttaatgctttcaacgtgtggaaaacccagcgggcctttagcaaatatgagaagtctgcagtgttggtcagcaacagccagttcttagtaaaaccacttgatatgattgttgggaaggcatggaatatgtttgcttcaaaagcctacattcatcagtacacaaaatttggaatcgaagaagaggactttttagacagtttcacgtcattagagcaggttgttgccagttactgtaatctctgatcttgaacaatgggaaaagtataccttaaggcatttctggactaaaatattttcaatactattttctctgtaaagttttcaaagttctccatccnggctaacanggtgaaacnccgtctctacnaanaatacaaaaaattagccaggcgnggtggcgggngcctntagtcccagctactcgggaggctgaggcaggagaatnncgtgnacccangaggcggagcttgcagtgagccnagatcgcgcnacngnactccagcctgggcnanagagcnagactccgtctc

SEQ ID NO: 72009 - DNA, 633 bp, Homo sapiens
gcccactgcaccctgcgttggagaggagctgacggagtgaggccgtgggaggtcgcagctggagaactccaggtgtgggctgctctagaggatgcttagaattgcgaggatgcagagtaaggtgtctccacccgtttccctggtgttatgaggtgcttcccatagtgtggagactaaaggtgtttatcacttaacagtatggcttccaagtttaactgtcccagaacccccctctccatgtaacacctggaaagttagttttcagtgaagtggccccactgtggctgaatccacccagctcctcacctgcaagttggcccacacgatgtgtcaagttggggacattaatgcttgttccacctgccctgggagacaagatcatagaagtgaaatgaccttgtaaacggcaaagtcctaagcaaatataatggtccttgttgagtcttttccgcattcatcactgatgtttgtctgacactgactgctgctccagaacccctcaggctgctgttggggagcgccaggacacacttgactcttgggcagttttaagtacgtttaaaattctcccgctgccagacgtggtgtactttaaagatgaattaaaatggatactttaaaagtaaaaaagct

SEQ ID NO: 72010 - DNA, 1142 bp, Homo sapiens
gtcagagcacagaggaggctcatatcacctcttccctctcctacttggcccagctgcttggaggaccgaccccatggctgagaatatgacggcaagaggaacagagtttgctccaagtgggaaagggtcccaagcagtccagagaagatgtctgtgtggctttccctccctgcctcccccagctcccacactggcctttgtaaataaatggcgtggtctttgttgtgaaaaaaaaaaaaaaaaaaaaaaaaaaaaaaaaaaaaaaaaaaaaaaaaaaaaaaaaaacaaaaaaaaaaaaaaaaaaaaaagagagagggggcgcgcgccgccagggagtcccccgggggggcaccaagaacgccgaccgacaccgctatgtttgtcggtagacacgaagagcggaggcggacgtaatagagaggaggggtgtgtgtatatatatatcaccgacagcgagcagcgaggcggcgccgcgcgcataaagacagaaaagagacgcgagcgggcggaccaggagcggcagagagcgggaggacaagaggagggggggaagagagacccaaaaagacacgagggaggggggaagacaaaatagaggaggcagcgccgaagaaggacgcaagagagagaggaagaagcagcgacgcgcgcggggggagagaaaaagaaagagagagcgccgacagagaacgcagaccaaagaccgagggagcgccaagcaccgggcgagaccggcaacaaaagagaggcgacgaggcgggccagagcaagagagaggagacacgagaccgacagcggcgcagagacgagagcaacaacgagagagaacgaactacccacgccaagggggagggaagggaaacgcgggaggagacaagagcgcggcgcgcggggcagcaggcagcgacagcgggggagacgggagacgccggagggggcggaggacgcgaggaagcggggcggggggaggccgcgagggcggcacggggcgcggaaccgggcggagcgagggggcgggagagacggaagggaagcggggagggaacaggcgaggcggggggggaggggcgaccgagggacgagccgggagaaaggaggcaggagccgggcagcccacgcaagaagaggagggaagagacgga

SEQ ID NO: 72011 - DNA, 1882 bp, Homo sapiens
ccgcggcgagtggagcgggagccgactggaagaagggctctagggagggggctgtggctgctggggtccgaggtggggccgggtacaccagccccatcactgtttgcagagagtcagggaggcggaaaagacacgcgctctaggctcccatcagggcacatggcccgggcccatcccccgcgcgtctccccggctgcggggcgcggggggctgccgggtgcgcttggctgtggcgcggcgcgttggagactttattgcgatgggacgataagaggggcgggggcggggtcctgggggccgaggcggcagcgctttaattaaaacggaaattgcggccccgggccgcgcgggggccggagggttccaagcggccccttagctggaagcgtttctccaggacccccccgcaacccccgccacgcccgggctgccccctcccgccaggccctgccggacccggcgccgtcttctcctccttgtcacccgcggtcgcttcgggcggggatcggtgccaccgagcgcaaagcctgcctcgccccccttccccgtcccccccatctcccaccgcccagtccccggcggcgatgagacagagcggcgcctcccagcccctgctgatcaacatgtacctgccagatcccgtcggagacggtctcttcaaggacgggaagaacccgagctgggggccgctgagccccgcggttcagaaaggcagcggacagatccagctgtggcagtttctgctggagctgctggctgaccgcgcgaacgccggctgcatcgcgtgggagggcggtcacggcgagttcaagctcacggacccggacgaggtggcgcggcggtggggcgagcgcaagagcaagcccaacatgaactacgacaagctgagccgcgccctgcgctactactacgacaagaacatcatgagcaaggtgcatggcaagcgctacgcctaccgcttcgacttccagggcctggcgcaggcctgccagccgccgcccgcgcacgctcatgccgccgccgcagctgctgccgccgccgcggccgcccaggacggcgcgctctacaagctgcccgccggcctcgccccgctgcccttccccggcctctccaaactcaacctcatggccgcctcggccggggtcgcgcccgccggcttctcctactggccgggcccgggccccgccgccaccgctgccgccgccaccgccgcgctctaccccagtcccagcttgcagcccccgcccgggcccttcggggccgtggccgcagcctcgcacttggggggccattaccactagacggggcggtcgggtgcctgcggcctcgcccgcacgcctagagtctcgcccgatcccatcggcatcccggggagggcccgggagcctccgtcaaccgtcctctaatccagagtttactccacctgccgcacttagcagggggacgggaccgaagctccctcaatccttgtctggtactagatttgctcctgtcccaccccgcagtcccctgaggagggcgatgtgcgccctctttcaccttttttcttctaggtctccaggtcccggaggggatttgtggacctctcttgtctccccaccactccagtgcatttccgcctggctcctagaagccccattcaatatcactactctttaacgagtgccaaatcttttcccacttttgctcttccccaaggaactgctcccacctcagcacgtggaggcctctcacggtcctccttcctgggacctgagcaggtttggtgaaagccaccgtcctccgtgacacacggcccccttcctcctgtccccacactcccaggagaaactcccggtgtgtttctgaccctttcagccccattaaagctcctgagctctca

SEQ ID NO: 72012 - DNA, 1227 bp, Homo sapiens
acaggctagtcgggctgggtgtgaatcggccgaggggcgctgagccccgcggttcagcagcggacagatccagctgtggcagtttctgctggagctgctggctgaccgcgcgaacgccggctgcatcgcgtgggagggcggtcacggcgagttcaagctcacggacccggacgaggtggcgcggcggtggggcgagcgcaagagcaagcccaacatgaactacgacaagctgagccgcgccctgcgctactactacgacaagaacatcatgagcaaggtgcatggcaagcgctacgcctaccgcttcgacttccagggcctggcgcaggcctgccagccgccgcccgcgcacgctcatgccgccgccgcagctgctgccgccgccgcggccgcccaggacggcgcgctctacaagctgcccgccggcctcgccccgctgcccttccccggcctctccaaactcaacctcatggccgcctcggccggggtcgcgcccgccggcttctcctactggccgggcccgggccccgccgccaccgctgccgccgccaccgccgcgctctaccccagtcccagcttgcagcccccgcccgggcccttcggggccgtggccgcagcctcgcacttggggggccattaccactagacggggcggtcgggtgcctgcggcctcgcccgcacgcctagagtctcgcccgatcccatcggcatcccggggagggcccgggagcctccgtcaaccgtcctctaatccagagtttactccacctgccgcacttagcagggggacgggaccgaagctccctcaatccttgtctggtactagatttgctcctgtcccaccccgcagtcccctgaggagggcgatgtgcgccctctttcaccttttttcttctaggtctccaggtcccggaggggatttgtggacctctcttgtctccccaccactccagtgcatttccgcctggctcctagaagccccattcaatatcactactctttaacgagtgccaaatcttttcccacttttgctcttccccaaggaactgctcccacctcagcacgtggaggcctctcacggtcctccttcctgggacctgagcaggtttggtgaaagccaccgtcctccgtgacacacggcccccttcctcctgtccccacactcccaggagaaactcccggtgtgtttctgaccctttcagccccattaaagctcctgagctctca

SEQ ID NO: 72013 - DNA, 893 bp, Homo sapiens
ctttaacattgtaaaggaaaaattatttcaaccttgagttctatacccagccaagctaccaagcaattggaaagatcaaatacagatattttcagacatgccaaggtcaggaaacttggagtagatgtccaccagaatgaagataataagccaggaaagagaaagacatgggacacaggaaacagatgctccaatgcaggagagaacagcagagatttctcaggatgacagtgaaaggaaactccaagacaccagctctgtagaagggccagaagtcaaacagttcagattggagggctccagagggaagactctcaggtgaatatggaattcacagattgcctggtgtggttgatagtactaagaggactaataattctgtcaaagaatgtagtatgagttagtgataagtacatagaaagctaagcaacatttctaaggtgaggcaactattaattcaaaaaaattgtccaaggaagtaaaagtagtcataatacagtacatagctgagctgtgaacagtatttgttgtcatcataatttaaacattgaatgttaatttagccaaaaattttagaataattaaattgagagaatgagacaaggtgaactgtgcatggatgtgggagattgtggtgagactgaatctagaaggaagttggtagagcatataaaaaattgaaaaacaactagcagccttcctgtgttattcaaacatatggagggaaatactagaagcagcagctaaaagagtggtatgtggctatttctggggagtaaaaattggaaacaggaaagggtgaggtagagaacttctgtgtgtaattgtaagacttggttaatgtttgactttgtaaactatgtgcatgttattaaactactacttggaacaaa

SEQ ID NO: 72014 - DNA, 771 bp, Homo sapiens
gaaacagagtcttgctctgtcgcacaggctgggctcaaactccaggcctcaagtgatcctctggcctcccaaagagctgggattacaggcgtgagccaccttgcccagcccaaaatgtccttttttaatatcctgtgataaaaacatatcttttgtagggagaagtgatagctcggctgccctggagagaggggacctcacctcggcagagctgcccccttgggagatgccccacgtgtacactgtgtggaaattcagtgtaagcgtttttttccccttgtatcttgggcatactacatttttctctttattagtaatacctgtgttagtcattgtgcgcactagaaacatcagttaatgcaagcctgatctaaactgtgaatgtggtaagatcaaaatcctgacccctctgtggagcacttggtctgcagctcaaggttgctgtccgtttctttgttgttccattagttgtcccaggatgacaaccttgtgcttggtgtgtgtcaccagccttgtgcttctaaccccctcccctgggtgtcccgggcactttgcagtttctcaggccccgggcagcagtgttgataggctcaaaactcctgaggcctggtaggttttgtaggtggattttttcccctcttctacttgttaacatttcttggctgggcacagtggttcatgcctgtaatcccagcactttgggagaccaaggtgggcggatcacttgaggttaggagttcgagaccagcctggccaacatggcgaaaccct

SEQ ID NO: 72015 - DNA, 306 bp, Homo sapiens
cttcctctccatcccaagaatgtgtttatgctttgacagaggagcagagtaatttccagctgatcagagaaaaggtgacttgtgtattccagaccatgtgttctactttgcagaccagcttcatttaatgctaaaattaggaacacattaatttgaggtattttatagtaaagcttaatggcatttttaattttggagaattttaaggatttttaaccattgctcccatctcgccatatgcacactcctgaagtatttttgaagctcttttgcttttctctgaactataaggttgtactagctgtt

SEQ ID NO: 72016 - DNA, 337 bp, Homo sapiens
tcttgttttttgtgagctctgacttaaagtatgttttaggaagtatgacattttttgacttaagatgtattttgcataatacaattgtaacctcttctgctctcatttcattaacatttgcatgaaatgtctatttccatcttgccactttcagtctctttttgtcattagatctcaagtgaatctcttgtaggtcagctgtagtttgatcttagtttggttttaaattatttagcatatgccttttgattgagtagtttagttcctaaataagcaatttactgaaatgaaaagatgtactttagccattgtattttttttacttgattcttgtagc

SEQ ID NO: 72017 - DNA, 574 bp, Homo sapiens
ctgtgccagtcaattaaaatagcaaatccttccctcattagccctctccacccactttatcctgtttcattttttcccatagcacttactggattatgctgattgtctttttccactagaatgcaggtattttgtctaggttgaatcactagtatctagaacagtgcctgacacatagtatgtgctcaataaatacacgtgtgcagaagcaaatcacatttttcattgctttccacaagtgtgagcctgggctacatagtgaaaccccatctctacaaaagatataaaaattggtctgggtgcagtggctcatgcctgtggtcccagcactttgggaggctgaggcgggcggatcacctggggttgggagttggagaccagcctggccaacatggagcaaccctgtctctacttaacatacaaaattagccaggcgtggtggctcatgcctgtaatcccagctactcagtaggctgaggcaggagaatcgcttgaacctgggaggcggaggttgcagtgagctgagatgagccattgcactccggcctgggtaacaagagtgaaactccgtctc

SEQ ID NO: 72018 - DNA, 400 bp, Homo sapiens
acattatttaattactattagtgaaaggatgaattaataaataaacaaatgtagaagtaatggagaagaggagggccagtcttcagtcaatgatgactctgcctctgttgaaaataccataccctatagacagatttaagaatacacaaggctcatgttcttggtttttgcattaatggattttgattctattattataaatagatcaatgaaagaatcaataaagcaatagaaacacacatgagtaatgaaatcatcgtacaattatgaaactatgtagggaaacgagaagccatttatatatatatggaaaaagtctgttaagaaataaatgtttcaaatgtgttacctctagctaaggatgatatagaggatataaataatatagatagataaaata

SEQ ID NO: 72019 - DNA, 519 bp, Homo sapiens
tggaagaataattaaagatctttaatagacccagcccgagtttcccatcgcactgagcactgagatcctgctggaagtctgccgcagcatgagctccgcagccgggttctgcgcctcacgccccgggctgctgttcctggggttgctgctcctgccacttgtggtcgccttcgccagcgctgaagctgaagaagatggggacctgcagtgcctgtgtgtgaagaccacctcccaggtccgtcccaggcacatcaccagcctggaggtgatcaaggccggaccccactgccccactgcccaactgatagccacgctgaagaatggaaggaaaatttgcttggacctgcaagccccgctgtacaagaaaataattaagaaacttttggagagttagctactagctgcctacgtgtgtgcatttgctatatagcatacttcttttttccagtttcaatctaactgtgaaagaacttctgatatttgtgttatccttatgattttaaataaacaaaataaatc

SEQ ID NO: 72020 - DNA, 602 bp, Homo sapiens
tatcttagtttccgcaccgcagttcctcggtgtccacttcaggcttccggactggaaggacagccgggaataaaacgtgccggcgaggttcaggagtcattggccacagagacccagcccgagtttcccatcgcactgagcactgagatcctgctggaagtctgccgcagcatgagctccgcagccgggttctgcgcctcacgccccgggctgctgttcctggggttgctgctcctgccacttgtggtcgccttcgccagcgctgaagctgaagaagatggggacctgcagtgcctgtgtgtgaagaccacctcccaggtccgtcccaggcacatcaccagcctggaggtgatcaaggccggaccccactgccccactgcccaactgatagccacgctgaagaatggaaggaaaatttgcttggacctgcaagccccgctgtacaagaaaataattaagaaacttttggagagttagctactagctgcctacgtgtgtgcatttgctatatagcatacttcttttttccagtttcaatctaactgtgaaagaacttctgatatttgtgttatccttatgattttaaataaacaaaataaatc

SEQ ID NO: 72021 - DNA, 751 bp, Homo sapiens
tggaagaataattaaagatctttaatagacccagcccgagtttcccatcgcactgagcactgagatcctgctggaagtctgccgcagcatgagctccgcagccgggttctgcgcctcacgccccgggctgctgttcctggggttgctgctcctgccacttgtggtcgccttcgccagcgctgaagctgaagaagatggggacctgcagtgcctgtgtgtgaagaccacctcccaggtccgtcccaggcacatcaccagcctggaggtgatcaaggccggaccccactgccccactgcccaactgatagccacgctgaagaatggaaggaaaatttgcttggacctgcaagccccgctgtacaagaaaataattaagaaacttttggagagttagctactagctgcctacgtgtgtgcatttgctatatagcatacttcttttttccagtttcaatctaactgtgaaagaacttctgatatttgtgttatccttatgattttaaataaacaaaataaatcaagttgtagtatagtcaaaatacttcttaataatagtgcaaaaattgtgttgacacataacaatttcatggaagaaaaaaattccggtattttaagcaaaaagtattttgaaggaaggtgtgaatactggttatgcttggtgttacatgttggctgatacatattcatgcatttacatgattgcagtactttatagctacatatttaccttgaccattattattacctttgc

SEQ ID NO: 72022 - DNA, 305 bp, Homo sapiens
gctgggactacaggcgcccgccaccacgcccggctaattttttgtatttttagtagagatggggtttcaccatgttggccaggatggtctcgatttcctgacctcatgatccgcccgcctcgacctcccaaagtgctgggattacaggcgtgagccaccgcgcccagcccaacacatggtattttctgtcattttcatttagtcttctggttgctgtgtgatggtctcaggctttatttacatttctccgattactaacagacttgaacatttcagcacactttttagttattgaataacctcta

SEQ ID NO: 72023 - DNA, 168 bp, Homo sapiens
cttgacattaaaagtaaccttgacataactgatggtctgtcctgaaatctatgtgaatgaattacagtgaaatttcccacatctgcttatagagataaaaatacatgaaagtataacaataattttaaaagaatacatatttgagcttaaagaaattctcacattcta

SEQ ID NO: 72024 - DNA, 449 bp, Homo sapiens
aaacccaatctgcttttagaatccaggggcaaaaggatcaggtggagcccagggtgggagcggggagggcagatggcaggtaccgtctcccagggccatctctccctcccttcgtgggcgtgcggccagctgggtcggcagtgagcacccctgttctgcctcacgtgcctcttaggtccttgatcagaagaacaggactgcatgcctgggggtgggtgcagtctggcgtgccaggtaagacccgtccttcatatccctcacgctaccaccccacagtggggcggcaagggagggtgcttttctgactgtgcctgtgttggggggctggcccttgcaggaccgagctggggactcagacttctaaacatgcacatttactgccccagcatgagcgcaggcgctcccatcacctcaaaatggtccagtgtggggatcacaccacagagctt

SEQ ID NO: 72025 - DNA, 529 bp, Homo sapiens
gctggaaatgagaaatctatataccaccttataaagcaagatggtgtgtgattttgacttgtagaccacaagcaggagattgatttttttgtggttaggataaagtatccagaggcaacatcatatacaggccccaaaagtgctgcatgtcaaacagcttatctggaggtgaatatgacgtggtttgcagaactgttaaagtttgggaaagtggttctagtgatggcagagacctgatgtaaaagactcgtgtgaaaagttttaataaaatagattcaaggagtgtgagaatggcaaaaagcaaagtattattttataagatgctttttaaaaaatatttacctgtaacatttaatgaatagtatttttctaacctagtcacacacactataaggtaataagttcaattcagtctacctgttgagtggcagactcatatatttgatatccaacacaatagttggatgtctattaggcatctcaaacttaacaggactgaaataaattcttggttttcttaaaaaaaaaa

SEQ ID NO: 72026 - DNA, 458 bp, Homo sapiens
tgcctcatggtggcttcttgttcctcatgactggtgaggttgggtgcccttgtattttaatcctgtgccaactgggcccccccacccccacccccgccacttgctgtctctgcttcgtaaggagatcttcttgcccggtcaactccgagggatcacaggttcaggggtgcccccaaaatgagacacttagtgtttgatgaatgaatgatgatgttgaggccaggagtgagaggaaggtcagcaggcagacagggcccatgtggacagaaagggtttattccaagtccagacatgaccaatagcgataaaaagggggaacaattggagtaatccatgggagaaggagtgagcctgaatttgaaagatggagagaactggacgtggaggaggggagggaggaaggcagaacaaaggaaataagaagctgttgaccaaaatacatatgttgtgattccatg

SEQ ID NO: 72027 - DNA, 322 bp, Homo sapiens
ttttgtttatgtaacattctcaaaatgacaaaattgtacacattggtgggaagaattgagggcggggaaggagaatataaaggggcagcagaagaatggtctcgttgtaatggaacagttctatatcttgaggtggtagttacagagatctgcacatgtgagaaaaatcatatagaacaccatgcacatggtgtatctgggtatgatatactatgttgtttatgacacaactatcagcggaaactgagtaaagggcgtatgagacttctctgtactacatttgcttcctgtgaatcttatttaaaaataaaaatttttaaca

SEQ ID NO: 72028 - DNA, 422 bp, Homo sapiens
aataaagcaaccactcctccttgtcaaatgtgctaaatatcattttaggagaagagagtggacttattgtatctcccttaagattgtgagggagtgtggatacagtagaatgagccaatagtttctttataataaatacggtctgcaataaattatttcactagctctaaaacctttccctagattttagtggggagttggtttctgttaatatctttgggtgctgtggtggtaaatgctacattataaacggtggcatgtatttacagttacagtattgtgtgtacactttttaatggtaaacttaagctgaatgtgtaatggacttgtgtatagttttacatatttggaagcattttaaaaataggttttaaccttacataaaattacttttatacttgtgttaacattttcttctgtgc

SEQ ID NO: 72029 - DNA, 343 bp, Homo sapiens
ttacggctgaatagtattccataatgtatacctaccacattttcttttattattattcttcttattattttttattattatactttaagttctagggtacatgtgcacaacatgcaggtttgttacatatgtatacctgtgccatgttggtgtgctgcacccattaactggtcatttacattaggtatatctcctaatgctatccctccccctccccccacctcatgacaggcccgatgtgtgatgttccccatcctgtgtcgaagtgttctcattgttcaatgtccacctatgagtgagaacatgcgacataccacattttctttatccgtttgtctgttga

SEQ ID NO: 72030 - DNA, 537 bp, Homo sapiens
gaacgaggccagtctgcctttatgccatgtggcctcaggcacctacagtgaagtcttaaaaccagtggatgctctctacagtgccttctagctgtggtagtctgtgtctccaaggaccaacccttccatttctgaggcttcagaataaattctggcagttatttcttctctcagactctatttcagaaaagtgtacctgccaacctgcatttagtaagaaataatgaattccttttctcattctttttatttttattttttatttttttgagacggagtttcgctcttgttgcccagtctgggatgcaatggcgcaatctcggctcaccgcaacccccacctccctggttcaagcgattctcctgcctcagcctcctgagtagctggaattacaggcatggtggcacttgcctgtaatcccagctacttgggaagctgaggcacaagaattgcttgaactcaggaggcagagattgcagtgagctgaaatcatgtcactgcactccagcgtgggctacagagaaagactctgtctca

SEQ ID NO: 72031 - DNA, 342 bp, Homo sapiens
gttcaagaccatcctggccaacatagtgagaccctgtctctaccaaaaacattagacagagctgggtgtggtggctcatgcttgtaatcccagcactttgggaggccaaggcaggtggatcacctgaggccaggagtttgagaccagactggccatcatggcaaaaccccgtctctactgaaaatacaaaaattagccgggcatggtggcacttgcctgtaatcccagctacttgggaagctgaggcacaagaattgcttgaactcaggaggcagagattgcagtgagctgaaatcatgtcactgcactccagcgtgggctacagagaaagactctgtctca

SEQ ID NO: 72032 - DNA, 569 bp, Homo sapiens
gtttttaaaaagcgatgtgaagtaatggtggtgccagtgcctcactgtttctaaagaccacatctggaatggctgtgacgtttcatcccgttgctttcggcttccatggacgtgactgcctggtttttcgttgattccccttgtctgtggcatcttgctgtggagtctgttcctgatgtttcactcggatatgtagttttctttgatcatgctctcagggttaggctttggtaatagaatgctggcttcatggagaatttggaagctttcctccttttcctaggctgtggaacagttaacttagccctggaggcagctggtccttaacaggtctggccaaagtcacttgttctttttttgcagggattgttgccccttgctggcttcctcaggctgctatttgttattttatctacttggattttctgtctcctggggattcgttttgataattcttattttcccagaaagccatttactcatctaagttttcagatttggagattttaaaaattcaagaaatagaaataatttctgaatagattatagtgactaaagaaactattaaa

SEQ ID NO: 72033 - DNA, 389 bp, Homo sapiens
agaaatgctactgatttttgtgcattgatttatgtctcaaagttttaaagaaaaaaatttaaagaagagactcaaaaaagcaattaaaaaaaaacagactctgtatactatagatacaggtaacatttccttcatatcattttagggtctgcctatttttcttatttcacataagcaatccctgtttttaaattaatgtgtattatagccatctacaattctatgatatgattgcatttatataacatttggttttaaaatttatcatacgacattttcattttaaatcaaaatatgtgtcactgcacctgaacactgatttgttcaataaagtttgatgagcattttagctccattttctagttatgattaaagataacaaaaataag

SEQ ID NO: 72034 - DNA, 811 bp, Homo sapiens
cattaaatcccacagggctgtaattcctagactctacgaatttcatcttgcaccaaattttattatttcatttataattcggattcttcaaatctaagagtgcctggctcaaaattaaaatacctacaactatgccaaaactggactctttaattgccttactggaaccagtagctgattcaaagcaaaacgaaacaaaattcctcctttctctgatttagtgaatcaatgatctaactgaactcatttttggactgagtttgcggcacttgcagccctgagggacacattcccccaccacactgagcctgcactcccatcaatgcaaatgaacattttgcttattcagattgggggggtgaaggaagtcacaaaagggttaatacatatggcatttcattgtaatatgtactcactactaactaaattaaaagagatgtgagttattaaaaactccatcttaagaaagtaacagaaatcagagttcagattcgttgttactgagtttccaaccaacacctgtgagttaaacctacggccaccctgaaaacggttcatattttcaaaagcttcatcgaagatgagctgcactaaagattcatattacatatcatgctgcaataagaaaatcaaataaggcctttccatattcaataataaagtttaaagaaaagtaatatttgtttagccagttagccagaaattagatgtatcagaatacatcattctttgagcattttagaaaaatcagggtatttctacattgtgtttttctttgtaagccctcaaaaaatatagagaatattcttga

SEQ ID NO: 72035 - DNA, 831 bp, Homo sapiens
gaatgggtttcaagtgattgtaccaaaataggaaaactataaatatatattcatacatatagtaaaatgttaagactgagatttagaattcatttaatgagcccaaattgtattttatgtatgagtaaactgaggcacagtaagactaagttaactgcccaaactcttccacctggttagtgggaaaataacatttccaaccctgatctttctggttcctgaaccaggatagctggactgtacttccccatttttgaaaaagctgctaaaaacttggttacaaactttaagtgacacgtttctccatttatgtggtggttatagcaacgtacaactctctatttataaattaaaccttgagaaacacccatctccactcctagacaaaccaatgaacattagtcttatttttctcccagaaatgtcagagggtgttacagtgctacacgagatgactcctgcaagttgcttgctagatagagttgcagttcatgtgaattgctttcagccaggttgggtatccaagctcaatgttctggtgttaagccatagggaagtgttgccatgagaccagcttcttggcaagtagccctgaggtgcagctgtaaggtgacccagtgcagtcctgaggccagagccctgtgctcagtgccagaaaacttgagccaaactttggaactaattcccagggcactgaaattggtctcaattaaaattttagatgaaaagggtttttgtttgtcctgaagaaccacttcaatttataaactcatagagaaagtagatattttgccggtgtacttggaatacctttcagaagccaaaccctta

SEQ ID NO: 72036 - DNA, 305 bp, Homo sapiens
ttatttttgtgaaaggaggctatctctttccttttatttttattatctagttttattgaactgtgtcagaaaatatgaaatatattattgtatttaaaatctaatggccaactttaataaatatgtcatggttatttataattttaatattttctacaatgaaaatatataactttttgtttcttatccatgattgttgagttaaacacatagttgatatttcctatactcttttttgttcaataataaatgcactaaagtctctaaaatattatctgagtaccattttgaactaaaatcatagg

SEQ ID NO: 72037 - DNA, 445 bp, Homo sapiens
tcaatccacttaaatagccacatgttgctagtggctaccacagtggacagcagagatctaaagacagaagacgaaataatcacacagaagataagctacccaaggacagagactcttatttttttttcttttttacttttaaaatctagcacctaacagtgcctgatacttacaaaaattttttaaaatgttattttaacctaaggagacattataaagtaaaaaatgtgaactatcagtgagcgacagggataacagactacaagttagctttaacagttctgtgaggaatgtttctagcacaaggaaaaatgtttaaggtgatacatatcccaattatactgatttgatctttacaaattatatgaatgtattagattatcatgagtactccaaaaatatgtatatttattaaatactaataaaaaattaataaatatttctg

SEQ ID NO: 72038 - DNA, 304 bp, Homo sapiens
caaaaaagaaatggaggccgggcgtggttgttcacatctgtactccttgaattttgggaggctgaggcaggcagattgcctgaggtcaggagctccagaggagcctggccaacatggtgaaatcccatctctactaaaaatacaaaaattagctgggtatggtggcgggcacctgtaatcccagctactcgggaggctgaggcaggagaattgcttgaacccagaaggtgaaggttgcagtgagccaaaatcgcaccattgcactccagcctgggtgacaagagaaagactcttatcttaaaaa

SEQ ID NO: 72039 - DNA, 713 bp, Homo sapiens
  misc_feature (2)..(2): n is a, c, g, or t
  misc_feature (5)..(8): n is a, c, g, or t
  misc_feature (10)..(12): n is a, c, g, or t
cngannnntnnntgcctctggagggttacctgttcccagagagttacctgcctcgagcattacctgccccaagagagttaactgttcccagagggttacctgttcacagagagttacttgcctccagaggattacttgcctccagagagttacccgttcccagagggttacctgcctacagggggttacctgttcctagagagttactgtgtctggagagttacttgccttcagagggttacccgccttcagaatgttatctgtccagcctgcttctgctctcacttggtctttccacttgcacactagagcccatctcctttcacctgttcagaattaagcaggatatggttaaaaagacattacttatgaagaacataacattttagtaaatgtatttgctaaatattgtatcaaataaaaatacatagagctttaagaaaggtgagaaatacttggggaataaaaccccattatattacaggatttccaaatactcacttacagaattaaacatctggtaaacaaaaatgaggacatagtacagttcattaatttaaaaagtaaatgtgtatgaagaatatgtattttttatatatctatgacacatttgcacaaatgaatgatgaattggccacatgaaaacattcatttctaaaagcaaagatttgacactcaaaattccctggtaataattcagtaaaatttaacag

SEQ ID NO: 72040 - DNA, 4036 bp, Homo sapiens
  misc_feature (3048)..(3048): n is a, c, g, or t
caagcaggctggtactggcccgagtgtatggatcggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaagagcctacagttcctgcagcagcagcactcggagatgctggccaagctccatgaggagatcgagcatctgaagcgggaaaacaaggatctccgttacaagctcataatgaatcagacatcacagaagaaaggtgagaactgggcccttcagttcctgatgggatgctcttgccacccaggggagcccctccagactgtccttgcccacctggctgcactggcccctgtatgccaacccagtggggacaggttctgggggacctggacagatgccgctacctctagccgtggctggatgatgttacgcagccaagcacagcacgtgctgctctcaggaagcccagggcctgaggtcattgcagtggggaggtgggcacagggtgctccccagacctccctcctccaagtagagctgaaatgggaaggaacccctgggacagcccctgccctgctagatctttgcctcagattgctgctgtggccaggcccaggatctccagccctatggctctgagtcctgacatgctgggggcccaggggctctggacacactccatccagggatcccttcctgccatctgggcagcaaccatggggacaaagggaggaagcagagtcctgtttccttgccacttgtccaaggcacttccccatcctgacagcggcccccacccagcccaggattctgggttgtggtctcgagctcacttcccgttatctttggggctggggctgacatcaggaggacatctgactggtggatggagccagcctgggaacatcgtagctggggcagtgcctagggctctcccttcccagagagacatggagaatggggttgagggagggcccttccctagccgctgtggcaactccagtgagctgttctgggcaaagtgtggcccaagtcggcagccccagccctgcagtgctggggacgctgacaggacacgggaagaggccatgctctccctcgggacctgctgttccatgtgtcccaagccctcctgctttccagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcgtgggcgtcttgcgggcggtagcgccgacactgtgcgctctcctgcagacagcctctccacgtcaagcttccagtctgtcaagtccatctctaattcaggtgagcaggctggcgtccatgtgctcacaggggtgagtgccccacggggaccccagcctgggtggcctctaggggtgctgaccaggtaccctctgctgggccaagctccaggatttggggatgaaggtgcagctgaaaagagccctgcaagctgaagccaccgggaggggattaagggggggtgggcaggaccagggaccagtcacagggcagtaaggcctcacagcaggcaccccagggtggggcagcaagcaggcaggaggggcctccccgggtggccgcctagggaggacgtaccctggctgcccagcagcagccctgcttggccgtgtccccgccacaagcaggcaggacacaggagggatggcactgcccacggagccctgggctcatggcaccttctgcagagtgaactgggagcagagagcctcttttccccactctgtgaggccgggcattttcctcagcccagccctaaccctcaccattcctgtgatgggcccaggtgctggacgggccttgtccttgccgaggaaacccatgcaggctgggtcccaagcctctcatgcagtttcattttacccaagatggggccagcttccactatgttgattgttctagagtgttcacaggcaccacccatgggcttcaccctcagaaccacattgattccccccagaaccctccaaggcaggcttccctttacagaggaggaaactgaggcagggacaggggcttcttgggtacacacagctgttcctggaaaacttgggcggtgactgttggtgcctgcagtgaccggccttgtagggtctgacttgcagccaactctcaaggcaaggccaggccccagcccggctccttcaacaagcaagattcaaaagctgacgtcccccagaaggcggacctggaagaggagcccctacttcacaacagcaagctggacaaggttcctggggtacaagggcaggccaggtaaggcttgggtgttcctggggtgcaagggcaggccaggtaagtcttgcctgcaccctaagggccccatgactacatttactaggctcacgccctgcagtcagccaactgctctgcccctagctccaggggcctgtctccagggctcatgatagcagatgacggccacgctctacccatcggtgggcgctgtcttcctcccttcccctgggggtcctgcagagtacctgtgctgacctgagcccacgaggggggccagtagcggcccctaaaccacttcctcagagaaaagtaaagtaatattctgaccaagagaaggcttgctgcccctggccacagcctgcctttggagggcactaggccagcaggtcagagtaggaacaggttctggtgatccctgagtttgcgggactgccctgagatgctacagagcgcacactttcagcagcgcaaccagcaggacaggctcctgcatctgcacatcccgagaccaggcctggagcaagatgccccactgggtgtggggtcacgancaagagcagcctggcagctagctggtcacccactgaagcccatctgacccttagggcaccttcagaggggagaaagggacaggccccagtcccagagacccccacctggtgcccagagcaccctgctcagtgggagaggggaaccaggccctcttccccacattggcctgggcgctgcctggggaggtatgctgggtgggtggttagacgcacctgggcaggtcacctctggctgctgcaatgactgtttcagaaaggagaaagcagaggcctctaacgcaggagctgcctgtatggggaacagccagcaccagggcaggcagatgggggcggcggcacaccccccaatgatcctgccccttcccctgcgaaagcccaccacacttaggcagtgcgaagtgctcatccgcgagctgtggaataccaacctcctgcagacccaagagctgcagcacctcaagtccctcctggaagggagccagaggccccaggcagtcccggaggaagctagctttcccagggaccaagaagccacgcatttccccaaggtctccaccaagagcctctccaagaaatgcctgcttctgagcccacctgtggcggagcgtgccatcctgcccgcactgaagcagaccccgaagaacaactttgccgagaggcagaagaggctgcaggcaatgcagaaacggcgcctgcatcgctcggtgctttgagctacccgcatctggtcagtgccaggcccaccaacctgcagctggagattggctctctatagcatttcctgatacttccgctacttttaggcctggctaaattccaagatagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaagttgtgt

SEQ ID NO: 72041 - DNA, 1555 bp, Homo sapiens
cagcgacagccccgcccccgccaaacgcctggcgccctccgtcgcccggtttccatggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaagagcctacagttcctgcagcagcagcactcggagatgctggccaagctccatgaggagatcgagcatctgaagcgggaaaacaaggatctccgttacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcgtgggcgtcttgcgggcggtagcgccgacactgtgcgctctcctgcagacagcctctccacgtcaagcttccagtctgtcaagtccatctctaattcaggcaaggccaggccccagcccggctccttcaacaagcaagattcaaaagctgacgtcccccagaaggcggacctggaagaggagcccctacttcacaacagcaagctggacaaggttcctggggtacaagggcaggccagaaaggagaaagcagaggcctctaacgcaggagctgcctgtatggggaacagccagcaccagggcaggcagatgggggcggcggcacaccccccaatgatcctgccccttcccctgcgaaagcccaccacacttaggcagtgcgaagtgctcatccgcgagctgtggaataccaacctcctgcagacccaagagctgcagcacctcaagtccctcctggaagggagccagaggccccaggcagtcccggaggaagctagctttcccagggaccaagaagccacgcatttccccaaggtctccaccaagagcctctccaagaaatgcctgcttctgagcccacctgtggcggagcgtgccatcctgcccgcactgaagcagaccccgaagaacaactttgccgagaggcagaagaggctgcaggcaatgcagaaacggcgcctgcatcgctcggtgctttgagctacccgcatctggtcagtgccaggcccaccaacctgcagctggagattggctctctatagcatttcctgatacttccgctacttttaggcctggctaaattccaagatagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaagttgtgt

SEQ ID NO: 72042 - DNA, 1329 bp, Homo sapiens
caagcaggctggtactggcccgagtgtatggatcggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaagagcctacagttcctgcagcagcagcactcggagatgctggccaagctccatgaggagatcgagcatctgaagcgggaaaacaaggatctccgttacaagctcataatgaatcagacatcacagaagaaagacagcctctccacgtcaagcttccagtctgtcaagtccatctctaattcaggcaaggccaggccccagcccggctccttcaacaagcaagattcaaaagctgacgtcccccagaaggcggacctggaagaggagcccctacttcacaacagcaagctggacaaggttcctggggtacaagggcaggccagaaaggagaaagcagaggcctctaacgcaggagctgcctgtatggggaacagccagcaccagggcaggcagatgggggcggcggcacaccccccaatgatcctgccccttcccctgcgaaagcccaccacacttaggcagtgcgaagtgctcatccgcgagctgtggaataccaacctcctgcagacccaagagctgcagcacctcaagtccctcctggaagggagccagaggccccaggcagtcccggaggaagctagctttcccagggaccaagaagccacgcatttccccaaggtctccaccaagagcctctccaagaaatgcctgcttctgagcccacctgtggcggagcgtgccatcctgcccgcactgaagcagaccccgaagaacaactttgccgagaggcagaagaggctgcaggcaatgcagaaacggcgcctgcatcgctcggtgctttgagctacccgcatctggtcagtgccaggcccaccaacctgcagctggagattggctctctatagcatttcctgatacttccgctacttttaggcctggctaaattccaagatagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaagttgtgt

SEQ ID NO: 72043 - DNA, 1755 bp, Homo sapiens
cagcgacagccccgcccccgccaaacgcctggcgccctccgtcgcccggtttccatggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaagagcctacagttcctgcagcagcagcactcggagatgctggccaagctccatgaggagatcgagcatctgaagcgggaaaacaaggatctccgttacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcgtgggcgtcttgcgggcggtagcgccgacactgtgcgctctcctgcagacagcctctccacgtcaagcttccagtctgtcaagtccatctctaattcaggcaaggccaggccccagcccggctccttcaacaagcaagattcaaaagctgacgtcccccagaaggcggacctggaagaggagcccctacttcacaacagcaagctggacaaggttcctggggtacaagggcaggccagaaaggagaaagcagaggcctctaacgcaggagctgcctgtatggggaacagccagcaccagggcaggcagatgggggcggcggcacaccccccaatgatcctgccccttcccctgcgaaagcccaccacacttaggcagtgcgaagtgctcatccgcgagctgtggaataccaacctcctgcagacccaagagctgcagcacctcaagtccctcctggaagggagccagaggccccaggcagtcccggaggaagctagctttcccagggaccaagaagccacgcatttccccaaggtctccaccaagagcctctccaagaaatggtaagtcccacaggcatggggacagtggggcagccctgcagcctgggccccagggagggagtggggaagggagcgtggcagcgcagaagcggagctcgctgaggcctctctgtgcccccgtgagggccatgcaggccgcactccccacacactccactcgcgaggatgctcacggtgacagtccctctacccgcccccagcctgcttctgagcccacctgtggcggagcgtgccatcctgcccgcactgaagcagaccccgaagaacaactttgccgagaggcagaagaggctgcaggcaatgcagaaacggcgcctgcatcgctcggtgctttgagctacccgcatctggtcagtgccaggcccaccaacctgcagctggagattggctctctatagcatttcctgatacttccgctacttttaggcctggctaaattccaagatagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaagttgtgt

SEQ ID NO: 72044 - DNA, 1499 bp, Homo sapiens
caagcaggctggtactggcccgagtgtatggatcggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaagagcctacagttcctgcagcagcagcactcggagatgctggccaagctccatgaggagatcgagcatctgaagcgggaaaacaaggatctccgttacaagctcataatgaatcagacatcacagaagaaagggcctctgctcccttgggcgctcgctgggtctgcatcaacggagtgtgggtagagccgggaggacccagccctgccaggctgaaggagggctcctcacggacacacaggccaggaggcaagcgtgggcgtcttgcgggcggtagcgccgacactgtgcgctctcctgcagacagcctctccacgtcaagcttccagtctgtcaagtccatctctaattcaggcaaggccaggccccagcccggctccttcaacaagcaagattcaaaagctgacgtcccccagaaggcggacctggaagaggagcccctacttcacaacagcaagctggacaaggttcctggggtacaagggcaggccagaaaggagaaagcagaggcctctaacgcaggagctgcctgtatggggaacagccagcaccagggcaggcagatgggggcggcggcacaccccccaatgatcctgccccttcccctgcgaaagcccaccacacttaggcagtgcgaagtgctcatccgcgagctgtggaataccaacctcctgcagacccaagagctgcagcacctcaagtccctcctggaagggagccagaggccccaggcagtcccggaggaagctagctttcccagggaccaagaagccacgcatttccccaaggtctccaccaagagcctctccaagaaatgcctgcttctgagcccacctgtggcggagcgtgccatcctgcccgcactgaagcagaccccgaagaacaactttgccgagaggcagaagaggctgcaggcaatgcagaaacggcgcctgcatcgctcggtgctttgagctacccgcatctggtcagtgccaggcccaccaacctgcagctggagattggctctctatagcatttcctgatacttccgctacttttaggcctggctaaattccaagatagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaagttgtgt

SEQ ID NO: 72045 - DNA, 1401 bp, Homo sapiens
cagcgacagccccgcccccgccaaacgcctggcgccctccgtcgcccggtttccatggtgacggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaagagcctacagttcctgcagcagcagcactcggagatgctggccaagctccatgaggagatcgagcatctgaagcgggaaaacaaggatctccgttacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcgtgggcgtcttgcgggcggtagcgccgacactgtgcgctctcctgcagacagcctctccacgtcaagcttccagtctgtcaagtccatctctaattcaggcaaggccaggccccagcccggctccttcaacaagcaagattcaaaagctgacgtcccccagaaggcggacctggaagaggagcccctacttcacaacagcaagctggacaaggttcctggggtacaagggcaggccagaaaggagaaagcagaggcctctaacgcaggagctgcctgtatggggaacagccagcaccagggcaggcagatgggggcggcggcacaccccccaatgatcctgccccttcccctgcgaaagcccaccacacttaggcagtgcgaagtgctcatccgcgagctgtggaatacctgcttctgagcccacctgtggcggagcgtgccatcctgcccgcactgaagcagaccccgaagaacaactttgccgagaggcagaagaggctgcaggcaatgcagaaacggcgcctgcatcgctcggtgctttgagctacccgcatctggtcagtgccaggcccaccaacctgcagctggagattggctctctatagcatttcctgatacttccgctacttttaggcctggctaaattccaagatagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaagttgtgt

SEQ ID NO: 72046 - DNA, 1630 bp, Homo sapiens
caagcaggctggtactggcccgagtgtatggatcggggcgccaggctagggcggcctggccactgagccggggtgcagtggcagcgggagagtacctggcgatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaagagcctacagttcctgcagcagcagcactcggagatgctggccaagctccatgaggagatcgagcatctgaagcgggaaaacaaggggtcagacacacctctgttaaaaactttatagaggggcccgggcgcggcggctcacgcctgtaattccagcactttgggagaccgagacgggcggatcgcgagatctccgttacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcgtgggcgtcttgcgggcggtagcgccgacactgtgcgctctcctgcagacagcctctccacgtcaagcttccagtctgtcaagtccatctctaattcaggcaaggccaggccccagcccggctccttcaacaagcaagattcaaaagctgacgtcccccagaaggcggacctggaagaggagcccctacttcacaacagcaagctggacaaggttcctggggtacaagggcaggccagaaaggagaaagcagaggcctctaacgcaggagctgcctgtatggggaacagccagcaccagggcaggcagatgggggcggcggcacaccccccaatgatcctgccccttcccctgcgaaagcccaccacacttaggcagtgcgaagtgctcatccgcgagctgtggaataccaacctcctgcagacccaagagctgcagcacctcaagtccctcctggaagggagccagaggccccaggcagtcccggaggaagctagctttcccagggaccaagaagccacgcatttccccaaggtctccaccaagagcctctccaagaaatgcctgcttctgagcccacctgtggcggagcgtgccatcctgcccgcactgaagcagaccccgaagaacaactttgccgagaggcagaagaggctgcaggcaatgcagaaacggcgcctgcatcgctcggtgctttgagctacccgcatctggtcagtgccaggcccaccaacctgcagctggagattggctctctatagcatttcctgatacttccgctacttttaggcctggctaaattccaagatagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaagttgtgt

SEQ ID NO: 72047 - DNA, 535 bp, Homo sapiens
tatatcataaagaaaacaaaaatattaaaatgagaagtacttctggaatagtggagtatgaaactctgaaattcttgtttccatgaaataaaaaaatccagaaaattatcaaaatcaactttttcagaactctgaaaattaaacaaaatctagcaacaatctgaacagcatttattcaagaaaaatggctgacttttagtaaaaataacaaacactgttatattttaactttccctatttccatccctctttccccaagtctgtattagccttgaaaaaaacaatagcctaggagccaataaagaggacaaactggtttggagctcgtcacaaagctccatccccagagaactactactattttatctctctggtagctggctgaaaaaccccattcaagaatttctctttatttcacctgactcagaatttgctcaatgaggaaagttctatccctaatatggcaaaaactatcagtctcaattatttagccttgcagctgccttaggtggtgaagccacatgggacaaacaag

SEQ ID NO: 72048 - DNA, 355 bp, Homo sapiens
ttcttaacaggaattcctagaaagaagccctgaatgtcctgaggtatcttttgcacctaaaatggtaataaccatgtactatctttgataaaatagtcattcaaatgaatttctatattctttagctcagctgaagaattgtgattggaaaaatccttggactctagaatgggacagtcaaataggattttctgtgacactggaaatgtttcatacctgtgctgtccaagagaactttctgtgacaatgaaaatgtttatatctgtgctcctcagtatggtagccactagctagatatggctgctgagtactggaaatatgggtaatgtgagatgaagtaaaattttcatttaat

SEQ ID NO: 72049 - DNA, 500 bp, Homo sapiens
tgcttcagtctttccccatttccagtctttcctgcattgcaccaacagatctgtcctcctataaaaccacagcctttatgactcttccctggcaaaggttctacgatggctcccaattcctcattaggttcattctcaatttctcaaaagtagaaattcaagcctctctctaacccagccaaccttagttcccttctccctactccaaactctccagtacaggaaggcctgtctggcttcttgttcttcctgacttgcaccattttcatttcaatccctagaccttggctcatattattgcctgtacttggaatgattcaccctccttgcctgccccagtctcaacaactctccattgcccattttgagttcaatttccttagtgaggacttattttctctcttcttcagtgcccccatgctttccacacagtcactgtgaaggattttcctctaaaggtcttcctgtttagagactgattccaaggtccccaaatgtgg

SEQ ID NO: 72050 - DNA, 1204 bp, Homo sapiens
ctttcagaggcccccagacacaacctgacccccttcgtccacacacctggccccagcctggatggatggggaggagttttctctcctcccctcaacccaagatccattgaggggaggctgaagcagaaggtccagcgagctccctgcgtcagtgccgccttcctcccacccaggtgctgctgtttagttctgaagaggaacggggcgcctttgtgcagcagctatgggacttctgcgtgcgctgggctctgggcctccatgtggctgagatgagcgagaaggagctatttaggaaggctgtgacaaagcagcagcgggaacgcatcctggagatcttcttcagacacctttttgctcaggtgccatgacctgtgccttttggagatgggtccagccccagaaatggaggaaacctgggctgcatagaacgcccctgtgggtgaactaagcttccgctctatggcctggagagaaatagccttgtttgaatcctggcattgccactttacttagctctgtgaccttaggcaagtcacattatcactgttctgtatctctgtttcctcatctataaaacagtgatgaaaactgtatccatcccattgcattgttgtgaggattcggtgagatcgtgtacatgagtggtacacagaggttggcctctggacccgagagcatcagcctcacctgggaacatgttagaaatgcacctacccagttagactgaaccaggaactctgtgggtggggcctggcaatctgtgttttaacaagctccccagatgattcagatacactctaatgtttgaaaaacattgttttatgtacagtgcttattggcccaagtgccaggtatgttgcaggcatttaacaaacggttgtggccaggcgcagtggctcatgcctataatcccagcactttgggaggctgaggcgggcagatcacctaaggtcaggagttcgagactagcatggccaacatggtgaaaccccatctctactaaaaatacaaaaattagctggacgtggtggctcacacctgtaatcccagctacttgggaggctgaggcaggagaatcgcttgaacccgggtggcggaggttgcagtgagccaagatcatgccactgcactccagcctgggtgacagagcaagactccatctcaaaaaaacaaacaaaaaacaataaatggttgttacatgcga

SEQ ID NO: 72051 - DNA, 138 bp, Homo sapiens
ctcctgcatccgaaagtgatcataggctgcctgtgcctaggtcattgatagtgcagggagaggaacgctgaaagaggttgtccccgtgtttggagggtccaccctatcccatccgaaccctgaagctttcacacaact

SEQ ID NO: 72052 - DNA, 379 bp, Homo sapiens
ttggcctccccactccagggaggagggagctgaggaaaggcttggcttctggcatttctcaattcctcccatctcctctgctggcttctccgggagaccctgtcctaggtgggcaggtggttggtacaccaaggactacctgaacagacaaaaccttaagggcacctcaaggcatgatgcagagaactggcccaggccagggtgcctgcatcttaaatgctgcttctgccaattcccagcttagtgcactcctgaactcctgcggcctacctcggcttctcacctggaacaccagtgaatcatgctggacgatttctttgtctctgtttataacaaatgccctttttccctcccccagccccagtttccttttgcttaa

SEQ ID NO: 72053 - DNA, 1220 bp, Homo sapiens
atggcgggacacctggcttcggatgcctgccttcttgccccctccaggcggtggaggtgatgggccaggggggccggagccgggctgggttgatcctcggacctggctaagcttccaaggccctcctggagggccaggaatcgggccgggagttgggtcaggctctgaggtgtgggggattcccccatgccccccgctgtatgagttctgtggggggatggcgtactgtgggcctcaggttggagtgcggctagtgccccaaggcggcttggagacctctcagcctgagggcgaagcaggagtcagggtggagagcaactccgatggcacctccctggagccctgcaccgtcccccctggtgccgtgaaactggagaaggagaagctggagcaaaacccgcaggagtcccagaacatcaaagctctgcagaaagaactcgaacaatttgccaagctcctgaagcagaagaggatcaccctgggatatacacaggccgatgtggggctcaccctgggggttctatttgggaaggtgttcagccaaacgaccatctgccgctttgagggtctgcagcttagcttcaagaacatgtgtaagctgcggcccttgctgcagaagtgggtggaggaagctgacaacaatgaaaatcttcaggagacatgcaaagcagaaaccctcttgcaggctcgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggtgccagaaaggcaagcaatcaagcagcgactatgcataacgagaggattttgaggctgctgggtctcctttctcaggggtaccagtatcctttcctctggccccagggccccattttggtaccccaggctatgggagccctcacttcactgcactgtactcctcggtccctttccctgagggggaagcctttcccccgtctccgtcaccaccctgggctctcccatgcattcaaactgaggtgcctgcccttctaggaatgggggacagggggaggggaggagctagggaaagagaacctggagtttgtgccagggcttttggaattaagttcttcattcactaaggaaggaattgggaacacaaagggtgggggc

SEQ ID NO: 72054 - DNA, 419 bp, Homo sapiens
acttaccccgtatttcttgcccctggtggagaccgcaagcctctctttattcccagctaccgaattcatggtggcttttccagaggagagtatctaaaggttccaccgacgctacatccagaaggtcctccaacccagaagcgtcccccggctgcagggggctggctctcagccctcagggcaaggtttcttcagcggtggggtgggagggaatgaaagcaaatggatcccacaagtaatagcaccaatttgcagaaagggttggggtcgctggtttattcttctcttcaaagcatgcttttcctcgtccccttctgcctcttccagccgcacgtcctcttgtcacggccacatccacagaactggcattttcttcagccaagtcagtccgtgctcccccacgaggaaagcgagggata

SEQ ID NO: 72055 - DNA, 696 bp, Homo sapiens
gagactgctagggcccaccaatatctgggtgctctgctccttctgtgggcatagctagacaacatttccccacccccttgcatctagatgggaccatgcaattagtcctggccagtgaaatgtggctggaagtgttgcacaccacttccaggcctgccttcttaaatcttctgtgagatcatacatagtctctctttatttgtctgctggctagatgcagaggatctaggagagaactctgaagtcctagagggtagctgagccacaagatgggaggaacctggatccctcagtgactgtgtggaccagtctctcataccatactacatccccatctttactgcattgtgatacagaggaaaaaattaaaactttgttatgtgaaaccactgagatttggagcttgcttgttacagttgaaggaaaccaaaacatttctcctcaaaacactgaggattgctaagttaaaaacactaaaaatgcaggggaacactctgcctcagcctctatttgcttgacagcaggacataaatccttccttactggacacttgcttattggcccagagaaggcagcaggaggcaccagaggaatctggaaatagattctactattttccactttctcccgccttttcaaagacgggaatgtctctctcttttgtcttgacactatgtactatttatggctctttgt

SEQ ID NO: 72056 - DNA, 570 bp, Homo sapiens
acttgttctttttactgatatttgcaagatggatatatatgttgtttccagagctctcaggtatttataagtagctcaacctaaattaaataaattgtcaccaacctatttacactctacattttattatgcctaaagagtcagtgatgataaattcggaattagagaagtaataacctccagaagcacctttactgggtcaccattccttttgatcaaagggtgtcatcagtacagaacttaagtattatgtcatttaatttacagtgctttggctaattttatttaacttaattaatttaacatcttgaattaggttggttacattttgactgtttttacagtcaaggaaacttgtagaaacacagcaaagctagtgaccttcacactttcacgcatgaacataaatgagctcataagatcatcgtctctttttgttgcgtttcaaaggcgtttacctatcttggagtaagatctaacatttctgaccttgataggataatcatagataacatacttttaaatgaatttacagagaaaaataaattttatttgtcctaaaaaaaataa

SEQ ID NO: 72057 - DNA, 190 bp, Homo sapiens
gtgctgtattgtgttcttccatcaagaggaagaacctcacattggttttttttattgtgttgttaatcgctattgctgttcaatggttaaatctgttaattcttgatgggttgcaaaacagttattatagtctcagtctctcattccttcctcatttattatctgaataatttctaagtaagagattcac

SEQ ID NO: 72058 - DNA, 1461 bp, Homo sapiens
gaatctggcagaatatagcagtttaacactttgaaaacttgaaatatctttagcctggtataatatgagagtaaacagttcattgatatttatggactcctaagtttggtactgttttattcagcagacaggtacgataagcatctaccttcccactccctacaactgtagtgtatgatactgggatgcttaaattagaggctcaccagtagtcatggaccagatttttttgttttttttagagttttcattagaactgtatatcttgctacttagcagagagtcagaagcattagtaggatctcctgttgtgaattcctgcttggtaaaggtttatgctggccctgtgttgattattgagtagcagatcattttgtttttggagagggtttgtgtgtttcacctccacaaaacacttattccccggagggggaatggtggtgctctgaggtgcaaagagggattctcaggtgcccagaacctctcatttgaggaatgcatacccccacggtgttattgagggctgaagttagatacggtaactgatttcttaattgtatatttcctatatgggtatgggaatgggcatgatcaaatgatgaagaatgattggcatagtgtttaaaacaatattgactttgaggatcttcccccactctgtgcacgtgcacacacacactcttgcaggccaatccctcagtaacaggagttttcagttgagtatgaatatttctgcttccttttaggagttaaatttcaagaaaatatccttagactggtaagcttttggtatcttaactgctaaaatctgaatatttgaccattaagatatattccaactcttaaatgtctatcttgaaaattaagattaacatgacctttttttttaatttcaaaaaattgcttttaaacattttctattctctgaatgtttgttccaagcatgttggggataggtgggaacagacagaatggaggtgaggtacttctatttaggactggcatcgcacagaaggaatatgcttcagtgctcctgttgagtatttttaaattctagtcaaagaaaatagggcttttggcattctcattagttagaaatatatttaggatgtcttcccttttctttagacaaaaccagaatatccaatatgtaaaagtgaactattctggtgaagatggggggttttgtgaagacctttcctgtcccacatgactagacgatgaggcattcacattatttccaggtgaagttttacttgtgtgttaggtggatctctacaatgatgagacctttcttgttttaccttcttcctagactctctggaacttttgatttttttttaaccatgaacctgtatttcacaataaactattggtatagtagtgtcattcataccctaccccatccccaacaactttgcgtagagaatacctcagatttgtttacctcagggaatactt

SEQ ID NO: 72059 - DNA, 940 bp, Homo sapiens
  misc_feature (936)..(937): n is a, c, g, or t
  misc_feature (940)..(940): n is a, c, g, or t
ccgatttcttgtgccaagaaactaatagaacttatccaaataaaaattagcaaacaattattctagggatattttcagattttacttcatttcttgaaatgcgtgtgccatatgcaattgcatttcttgtgccaagaaactaatagaacttatttcactttacctttttttaaaatgtgaatttagttattatagttcaattttatggccttacagatggcttttattttgtttgcagctgacactgcagttcctttcatgcaaaataccataaactgtttgatgaaaatcatgcccctaatggaaactctctagtttttccatataactatcctactgtacatgtttaaacatattttatttttgctccaatggcttaatgtgaaaagctcctgcagataagtggacctgtcatgtggttaatcttgtttaagccaattcattaactgtgtactgatactgatgctatgttttttttaaatggattttattccaggtgaactttttttttataataatgttcgtctaaaataaaaactacataatgaaaatgaaaaaaaaaaaaaaaaaaaaaaaaaaaaaaaaaaaaaaaaaaaaaaaaaaaaaaaaaaaaaaaataaaaaaagagaggaggaaaaaaaaaccaacagacacacagaagattgatggtcgtcgcccgtccgcagacagagaaatctactaaacgccgttgatggtggggccgcccaccaacaagtagtaggtgaaaagatcgaacaatgttgcacaagcacaagaatgggcttcgaagagacgaggggcgggggctaccaaccaaaaaagagggccggcgcgaacgggaggtttgtatcacacacgcggggagtgagtgagcaatgaagtggcttacaagaggagccacgacgagatatatacacgcgggccggggagggaggnngan

SEQ ID NO: 72060 - DNA, 1107 bp, Homo sapiens
ctctctgaagagctccataaatctctggtgctgccagtctgactactgggggttagggggacagagaagtaacgtcacaagattttaagcttgggccagatatgggaaataatttaatcctagatcacattttacacatgaataactgagaacagaaagaagtgatttgcctgtgctcatacagcctttaaaaagaagagccaggattaaaacatctggttcccagcttctatcccaccatgctgtttggctagcaacaattatctctttaccttggcaactttttgcccttctgacattttctccatcttagatatttgaagattgttttaattccaggataattggtattaagatttttttaatgtctttgtcacttaagaaagaaatctgactctgaaataattttgtacacgtttctataaacttagatgaatttctttttaaaatagtacagaatctagaataccatctccactggttcactcagtaccaagtttttgtccttctttgacctgaatatttggaaattttgtcattagatcaccataagctttatttgtgtttgttccaccttctttccaaacctcgggaagaaggtttgcacaggctctgtgagggctcttgtactgtagctttgcccctcttcccatctttaaacttttctctgaattaggccttgtgtgagtaaaagattatgtcttattaaattcatgtgtttctgacaggttggatttgtctattaagtaacgggtttttctcaggctgtttttatagcatgctattttctccctgcagcatgcctcttccgatgtcgaaagaatgatcctgggtaacaaatgtgatatgaatgacaaaagacaagtgtcaaaagaaagaggggagaaggtaaatgtgaatggaatggataaaggttggaatctactcacattaagcatttcttttcttcatattatttaattattgattttttttaaaatctgtgttttaatccctttaaattggatatcaacaacaaagagatgtaatccatacttgaatggtgtgaattagtattcgagatccagcactgcactccagcctgggcaacagagtaagactctgttt

SEQ ID NO: 72061 - DNA, 864 bp, Homo sapiens
acggggcggggcgcgcaggccttctccgagaggaggggcggggcgtggggcggggcgagcagcggcggattggcgggcacgccccctcgcccgcggccccctccccgcctctctccaccgcctcctctggctccccggtcagagggccggagcgagaagatggcgaagacgtacgattatctcttcaagctcctgctgatcggcgactcgggggtaggcaagacctgcctcctgttccgcttctcagaggacgccttcaacaccaccttcatctccaccatcgtgcggcctcacatagaggaataaaaacaacccattttattatcccacaaaatgtctgctaatgaagcagtgtgatgtagtggacagagtattggatttggaatcactgtcacttatagcactgtggtgttgggaattgattttaaaattagaacgatagaactagatggaaagaaaattaagcttcagatatgggacacagcgggtcaggaaagattccgaacaatcacgacagcgtactacagaggagccatgggcattatgctggtctatgacatcacaaatgaaaaatcctttgacaatattaaaaattggatcagaaacattgaagagcatgcctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcctttttacactggcacgagatttatgacaaacctcaacgaaaaatgattgaccagcattcaccaggagcaggtggcccagggaaattacag

SEQ ID NO: 72062 - DNA, 402 bp, Homo sapiens
gggtgtatcacctttaccacgatcactaattcattaaaggttaacagtgaaaatgttaaaagggtttttatttacatggtgagaccagtggaataagtatttattgatttttgtttctctgtacttttcaaatttattatgaaccctttttaaagggaaaaaatggacaaacaaaaggtttctggagggtaggagtacattgacattatatactataactttaaatatataaagtactaaataaagatatttttcccccttatagggcattatgctggtctatgacatcacaaatgaaaaatcctttgacaatattaaaaattggatcagaaacattgaagagccccagggggtttccaaatcagaaccattggaaaagactcctcgctgggctagcttgta

SEQ ID NO: 72063 - DNA, 5323 bp, Homo sapiens
  misc_feature (5319)..(5320): n is a, c, g, or t
  misc_feature (5323)..(5323): n is a, c, g, or t
acggggcggggcgcgcaggccttctccgagaggaggggcggggcgtggggcggggcgagcagcggcggattggcgggcacgccccctcgcccgcggccccctccccgcctctctccaccgcctcctctggctccccggtcagagggccggagcgagaagatggcgaagacgtacgattatctcttcaagctcctgctgatcggcgactcgggggtaggcaagacctgcctcctgttccgcttctcagaggacgccttcaacaccaccttcatctccaccatcggaattgattttaaaattagaacgatagaactagatggaaagaaaattaagcttcagatatgggacacagcgggtcaggaaagattccgaacaatcacgacagcgtactacagaggagccatgggcattatgctggtctatgacatcacaaatgaaaaatcctttgacaatattaaaaattggatcagaaacattgaagagcatgcctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgagatataatgacaaaactcaacagaaaaatgaatgacagcaattcagcaggagcaggtggaccagtgaaaataacagaaaaccgatcaaagaagaccagtttctttcgttgctcgctactttgatgaactctttctgagagactgcagcacacctagagggccctttcctgcttctctgaaagcacaggtcacccagcctcagaatcacacctcccggctgctgctgagagcaccactgaacttagacctctcaacacagtatgccaagtggattccagcctcatggcctagcaaaagaacagactccctttttcaaacatggaagcaatgaagtggagacacatgcaggacctaactcgttttttccttgttttattacctgttgcagaagcggttatctttcttttttactttgcacatcagtgttagcctttccctatttcagcacaatcttagactcatatttgcacacttttgtgtcgtgaagttctagacaaatttgtacatgtggcaatgttaaaagagcatttacagcagaggttaatatactaaaattaaagggtatttggtctggttcatatggtcaaatattactgccttggtagcatttatttaagggctttttcttaaataagaatcattaaagtcattaaaaaaatttactgaaatgcccatcttgtcatcaaaggccacaatttctttatttcttcagattaagagctttgcctcatccccgacctgttttccagagtctgggtagctgaatgaatcactttaaaatgattacctctgcctaatctatagaaactgcatttggaaatcaccataatctcatttttccctggggtttgtatttgctattctttcccatgtttgacttaagtgtaatcactcttaagtaatatttgaacattattatctgtttctatttgtgaacttcttgagctgaaattttacgtgggctgagagatataccatttagggttttagtgcagcatctaactgtgattctgtcaataaggatatgtaatatattttttcttaggttcactccttagctggctggtttagttgtaataccaaattcctaccataatccctgtctacaaaagttaggtttagattttagtttgcggaaaccttccctatatagagacagattaacttgttgatataaatttaatagagctagctcttggtaatggtgaaaataatgagttttggttggttttatttggcagatgtttttagaaataaaagtacttagacctagtgcagcctctaggaaaagtcttgccttttcattagagaaaacaggaccaaggtttcagttttcaaacagctgttgttgaatgtgtagaacccagttccatctgttttggttcattgttacagaacttagtccagtcatttgggctaaagccaaccaaaagcttagttgcctttctcaacaaacactggtactggtatacttttgtagatgaaaccatcacaaggtatttagtgttaacttgtgtgccaaattcagatcactatgtcgttgttgctctagccttcagtgtcataacacaggggggataaaacagaggggatgagggaaatgaattctgttaataattattcttcctggtatgcctgttttgcttcacaaaggctactatcatgctggatagataagaacaggagatggcagtggaaagggattgcttgttaccacagagaattctcttcaaattaagatatgtcattagaatgcttggaccagtcaatcttttgtacttatttgaaaatataggaacaatttagcagctgcaaatatgcccaagctatttttaatagatatactaaacttattgttgacaaatttcagcctccttaatttttttttttttggtaattacctataggcttaaaagtcattcgttgctgttctagtataattagtagttccgtgattgaaagtttattgtaattctactatcttcaaattagatacattttcaaaaggaaaagataattttttagaaacatcttaatattcactatttcctgaaaaaatccaagcagttaacgctttctggatggtaacaaagtaccttctaaaagataagtgctatgacaccatgtatgaatgtaattctcttagtaatttacctctgactatttggtgtcttaacgctttggtttatataatctcaggggttgtctgcaaaccaaaactgacatattctgtggttagcttttattacttttttttttaacagaatgctttgctttggttatatttcttctttcttcttttgtcttatatggattaataactagtctccatgaacttcacttgaaagagcctgtaaaagttagatgagtctaaaagtgctctttgaagtagcagcaaattgggagtatatgctctgttatatagaaataaattgtccttgctattttcttacatttagctttgctagattgtatatacattgagctaagaccttaggaaattcactttctgcatgataaaatgacccaataaatattccactttgcttaataatgtacatacagtgcattattttttctatttgtagatgaatttaatgacagataattgtctgttccccgctgaaactgaagaaatctagtttttttgtgaacatttttgtggtcttatggataaggtacatgaagatttttgcagcagtattagtggttcagtggctgcactttattaatcagtgtgttaatttttgacagtgattggactagaccttttcaaatagagtctgagggtatcagacagtgaaaatgtgctgtaactaagtagcatgtaaatcagttgattgtaaaacgtttcgctgggaacttattttagctatattttacttcagacagattatgatacaataatctacctgtgcatcagttagtaggtgctgcagggtttcttactatttacagaaacattttgtgcagtctttgttataaattttcagaagactatactctttactttgaaggtctattttttaattatacctcatttagctaactagtattctaatacctggtagaaaaacagtgagccagcctttaagcatctaacaaaatttagactctttgttttgttttgaactgaagacatcattgggaaaggtaggaaatattagtttaggatagagcatacatgtcatatccagtagcataaaaaaagtattatctccctgtctccattaataaatttagctgtgcaatataggtgcgtttttgcagaagtttctagtaagagattataactccattttacaggttctgaatgctcagagtctatattaaggcttataaagtttttcctgtgatcagtaagtgacacatttaagcagacattcttttcaagttcatgacttagattcctttacaaatttagttctcaatctttaaaaaccacatttcattatgttggttaattattataaattttaagcactcatttctgcaatcaggtttctcagaattttttttttttaaacagaagagacattcctttttccttgttacatccaaggggggcacaggggtgggtggaaaggaatgtctaaaaatgaaatcccttgatatagagggacctagacggacaggatatgctaaaataatttcaaattctagcacaattttagagtagaataagtcatttttttagactaataaaattaatggctgtcatgttcactctgaaaaaaatctaaatgactgaaatgtacagaaataaaaattagcaaacaattattctagggatattttcagattttacttcatttcttgaaatgcgtgtgccatatgcaattgcatttcttgtgccaagaaactaatagaacttatttcactttacctttttttaaaatgtgaatttagttattatagttcaattttatggccttacagatggcttttattttgtttgcagctgacactgcagttcctttcatgcaaaataccataaactgtttgatgaaaatcatgcccctaatggaaactctctagtttttccatataactatcctactgtacatgtttaaacatattttatttttgctccaatggcttaatgtgaaaagctcctgcagataagtggacctgtcatgtggttaatcttgtttaagccaattcattaactgtgtactgatactgatgctatgttttttttaaatggattttattccaggtgaactttttttttataataatgttcgtctaaaataaaaactacataatgaaaatgaaaaaaaaaaaaaaaaaaaaaaaaaaaaaaaaaaaaaaaaaaaaaaaaaaaaaaaaaaaaaaaataaaaaaagagaggaggaaaaaaaaaccaacagacacacagaagattgatggtcgtcgcccgtccgcagacagagaaatctactaaacgccgttgatggtggggccgcccaccaacaagtagtaggtgaaaagatcgaacaatgttgcacaagcacaagaatgggcttcgaagagacgaggggcgggggctaccaaccaaaaaagagggccggcgcgaacgggaggtttgtatcacacacgcggggagtgagtgagcaatgaagtggcttacaagaggagccacgacgagatatatacacgcgggccggggagggaggnngan

SEQ ID NO: 72064 - DNA, 3209 bp, Homo sapiens
acggggcggggcgcgcaggccttctccgagaggaggggcggggcgtggggcggggcgagcagcggcggattggcgggcacgccccctcgcccgcggccccctccccgcctctctccaccgcctcctctggctccccggtcagagggccggagcgagaagatggcgaagacgtacgattatctcttcaagctcctgctgatcggcgactcgggggtaggcaagacctgcctcctgttccgcttctcagaggacgccttcaacaccaccttcatctccaccatcggaattgattttaaaattagaacgatagaactagatggaaagaaaattaagcttcagatatgggacacagcgggtcaggaaagattccgaacaatcacgacagcgtactacagaggagccatgggcattatgctggtctatgacatcacaaatgaaaaatcctttgacaatattaaaaattggatcagaaacattgaagagcatgcctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgagatataatgacaaaactcaacagaaaaatgaatgacagcaattcagcaggagcaggtggaccagtgaaaataacagaaaaccgatcaaagaagaccagtttctttcgttgctcgctactttgatgaactctttctgagagactgcagcacacctagagggccctttcctgcttctctgaaagcacaggtcacccagcctcagaatcacacctcccggctgctgctgagagcaccactgaacttagacctctcaacacagtatgccaagtggattccagcctcatggcctagcaaaagaacagactccctttttcaaacatggaagcaatgaagtggagacacatgcaggacctaactcgttttttccttgttttattacctgttgcagaagcggttatctttcttttttactttgcacatcagtgttagcctttccctatttcagcacaatcttagactcatatttgcacacttttgtgtcgtgaagttctagacaaatttgtacatgtggcaatgttaaaagagcatttacagcagaggttaatatactaaaattaaagggtatttggtctggttcatatggtcaaatattactgccttggtagcatttatttaagggctttttcttaaataagaatcattaaagtcattaaaaaaatttactgaaatgcccatcttgtcatcaaaggccacaatttctttatttcttcagattaagagctttgcctcatccccgacctgttttccagagtctgggtagctgaatgaatcactttaaaatgattacctctgcctaatctatagaaactgcatttggaaatcaccataatctcatttttccctggggtttgtatttgctattctttcccatgtttgacttaagtgtaatcactcttaagtaatatttgaacattattatctgtttctatttgtgaacttcttgagctgaaattttacgtgggctgagagatataccatttagggttttagtgcagcatctaactgtgattctgtcaataaggatatgtaatatattttttcttaggttcactccttagctggctggtttagttgtaataccaaattcctaccataatccctgtctacaaaagttaggtttagattttagtttgcggaaaccttccctatatagagacagattaacttgttgatataaatttaatagagctagctcttggtaatggtgaaaataatgagttttggttggttttatttggcagatgtttttagaaataaaagtacttagacctagtgcagcctctaggaaaagtcttgccttttcattagagaaaacaggaccaaggtttcagttttcaaacagctgttgttgaatgtgtagaacccagttccatctgttttggttcattgttacagaacttagtccagtcatttgggctaaagccaaccaaaagcttagttgcctttctcaacaaacactggtactggtatacttttgtagatgaaaccatcacaaggtatttagtgttaacttgtgtgccaaattcagatcactatgtcgttgttgctctagccttcagtgtcataacacaggggggataaaacagaggggatgagggaaatgaattctgttaataattattcttcctggtatgcctgttttgcttcacaaaggctactatcatgctggatagataagaacaggagatggcagtggaaagggattgcttgttaccacagagaattctcttcaaattaagatatgtcattagaatgcttggaccagtcaatcttttgtacttatttgaaaatataggaacaatttagcagctgcaaatatgcccaagctatttttaatagatatactaaacttattgttgacaaatttcagcctccttaatttttttttttttggtaattacctataggcttaaaagtcattcgttgctgttctagtataattagtagttccgtgattgaaagtttattgtaattctactatcttcaaattagatacattttcaaaaggaaaagataattttttagaaacatcttaatattcactatttcctgaaaaaatccaagcagttaacgctttctggatggtaacaaagtaccttctaaaagataagtgctatgacaccatgtatgaatgtaattctcttagtaatttacctctgactatttggtgtcttaacgctttggtttatataatctcaggggttgtctgcaaaccaaaactgacatattctgtggttagcttttattacttttttttttaacagaatgctttgctttggttatatttcttctttcttcttttgtcttatatggattaataactagtctccatgaacttcacttgaaagagcctgtaaaagttagatgagtctaaaagtgctctttgaagtagcagcaaattgggagtatatgctctgttatatagaaataaattgtccttgctattttcttacatttagctttgctagattgtatatacattgagctaagaccttaggaaattcactttctgcatgataaaatgacccaataaatattccactttgctt

SEQ ID NO: 72065 - DNA, 4421 bp, Homo sapiens
acggggcggggcgcgcaggccttctccgagaggaggggcggggcgtggggcggggcgagcagcggcggattggcgggcacgccccctcgcccgcggccccctccccgcctctctccaccgcctcctctggctccccggtcagagggccggagcgagaagatggcgaagacgtacgattatctcttcaagctcctgctgatcggcgactcgggggtaggcaagacctgcctcctgttccgcttctcagaggacgccttcaacaccaccttcatctccaccatcggaattgattttaaaattagaacgatagaactagatggaaagaaaattaagcttcagatatgggacacagcgggtcaggaaagattccgaacaatcacgacagcgtactacagaggagccatgggcattatgctggtctatgacatcacaaatgaaaaatcctttgacaatattaaaaattggatcagaaacattgaagagcatgcctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgagatataatgacaaaactcaacagaaaaatgaatgacagcaattcagcaggagcaggtggaccagtgaaaataacagaaaaccgatcaaagaagaccagtttctttcgttgctcgctactttgatgaactctttctgagagactgcagcacacctagagggccctttcctgcttctctgaaagcacaggtcacccagcctcagaatcacacctcccggctgctgctgagagcaccactgaacttagacctctcaacacagtatgccaagtggattccagcctcatggcctagcaaaagaacagactccctttttcaaacatggaagcaatgaagtggagacacatgcaggacctaactcgttttttccttgttttattacctgttgcagaagcggttatctttcttttttactttgcacatcagtgttagcctttccacgtgggctgagagatataccatttagggttttagtgcagcatctaactgtgattctgtcaataaggatatgtaatatattttttcttaggttcactccttagctggctggtttagttgtaataccaaattcctaccataatccctgtctacaaaagttaggtttagattttagtttgcggaaaccttccctatatagagacagattaacttgttgatataaatttaatagagctagctcttggtaatggtgaaaataatgagttttggttggttttatttggcagatgtttttagaaataaaagtacttagacctagtgcagcctctaggaaaagtcttgccttttcattagagaaaacaggaccaaggtttcagttttcaaacagctgttgttgaatgtgtagaacccagttccatctgttttggttcattgttacagaacttagtccagtcatttgggctaaagccaaccaaaagcttagttgcctttctcaacaaacactggtactggtatacttttgtagatgaaaccatcacaaggtatttagtgttaacttgtgtgccaaattcagatcactatgtcgttgttgctctagccttcagtgtcataacacaggggggataaaacagaggggatgagggaaatgaattctgttaataattattcttcctggtatgcctgttttgcttcacaaaggctactatcatgctggatagataagaacaggagatggcagtggaaagggattgcttgttaccacagagaattctcttcaaattaagatatgtcattagaatgcttggaccagtcaatcttttgtacttatttgaaaatataggaacaatttagcagctgcaaatatgcccaagctatttttaatagatatactaaacttattgttgacaaatttcagcctccttaatttttttttttttggtaattacctataggcttaaaagtcattcgttgctgttctagtataattagtagttccgtgattgaaagtttattgtaattctactatcttcaaattagatacattttcaaaaggaaaagataattttttagaaacatcttaatattcactatttcctgaaaaaatccaagcagttaacgctttctggatggtaacaaagtaccttctaaaagataagtgctatgacaccatgtatgaatgtaattctcttagtaatttacctctgactatttggtgtcttaacgctttggtttatataatctcaggggttgtctgcaaaccaaaactgacatattctgtggttagcttttattacttttttttttaacagaatgctttgctttggttatatttcttctttcttcttttgtcttatatggattaataactagtctccatgaacttcacttgaaagagcctgtaaaagttagatgagtctaaaagtgctctttgaagtagcagcaaattgggagtatatgctctgttatatagaaataaattgtccttgctattttcttacatttagctttgctagattgtatatacattgagctaagaccttaggaaattcactttctgcatgataaaatgacccaataaatattccactttgcttaataatgtacatacagtgcattattttttctatttgtagatgaatttaatgacagataattgtctgttccccgctgaaactgaagaaatctagtttttttgtgaacatttttgtggtcttatggataaggtacatgaagatttttgcagcagtattagtggttcagtggctgcactttattaatcagtgtgttaatttttgacagtgattggactagaccttttcaaatagagtctgagggtatcagacagtgaaaatgtgctgtaactaagtagcatgtaaatcagttgattgtaaaacgtttcgctgggaacttattttagctatattttacttcagacagattatgatacaataatctacctgtgcatcagttagtaggtgctgcagggtttcttactatttacagaaacattttgtgcagtctttgttataaattttcagaagactatactctttactttgaaggtctattttttaattatacctcatttagctaactagtattctaatacctggtagaaaaacagtgagccagcctttaagcatctaacaaaatttagactctttgttttgttttgaactgaagacatcattgggaaaggtaggaaatattagtttaggatagagcatacatgtcatatccagtagcataaaaaaagtattatctccctgtctccattaataaatttagctgtgcaatataggtgcgtttttgcagaagtttctagtaagagattataactccattttacaggttctgaatgctcagagtctatattaaggcttataaagtttttcctgtgatcagtaagtgacacatttaagcagacattcttttcaagttcatgacttagattcctttacaaatttagttctcaatctttaaaaaccacatttcattatgttggttaattattataaattttaagcactcatttctgcaatcaggtttctcagaattttttttttttaaacagaagagacattcctttttccttgttacatccaaggggggcacaggggtgggtggaaaggaatgtctaaaaatgaaatcccttgatatagagggacctagacggacaggatatgctaaaataatttcaaattctagcacaattttagagtagaataagtcatttttttagactaataaaattaatggctgtcatgttcactctgaaaaaaatctaaatgactgaaatgtacagaaataaaaattagcaaacaattattctagggatattttcagattttacttcatttcttgaaatgcgtgtgccatatgcaattgcatttcttgtgccaagaaactaatagaacttatttcactttacctttttttaaaatgtgaatttagttattatagttcaattttatggccttacagatggcttttattttgtttgcagctgacactgcagttcctttcatgcaaaataccataaactgtttgatgaaaatcatgcccctaatggaaactctctagtttttccatataactatcctactgtacatgtttaaacatattttatttttgctccaatggcttaatgtgaaaagctcctgcagataagtggacctgtcatgtggttaatcttgtttaagccaattcattaactgtgtactgatactgatgctatgttttttttaaatggattttattccaggtgaactttttttttataataatgttcgtctaaaataaaaactacataatgaaaatgaaaa

SEQ ID NO: 72066 - DNA, 5255 bp, Homo sapiens
ctctctgaagagctccataaatctctggtgctgccagtctgactactgggggttagggggacagagaagtaacgtcacaagattttaagcttgggccagatatgggaaataatttaatcctagatcacattttacacatgaataactgagaacagaaagaagtgatttgcctgtgctcatacagcctttaaaaagaagagccaggattaaaacatctggttcccagcttctatcccaccatgctgtttggctagcaacaattatctctttaccttggcaactttttgcccttctgacattttctccatcttagatatttgaagattgttttaattccaggataattggtattaagatttttttaatgtctttgtcacttaagaaagaaatctgactctgaaataattttgtacacgtttctataaacttagatgaatttctttttaaaatagtacagaatctagaataccatctccactggttcactcagtaccaagtttttgtccttctttgacctgaatatttggaaattttgtcattagatcaccataagctttatttgtgtttgttccaccttctttccaaacctcgggaagaaggtttgcacaggctctgtgagggctcttgtactgtagctttgcccctcttcccatctttaaacttttctctgaattaggccttgtgtgagtaaaagattatgtcttattaaattcatgtgtttctgacaggttggatttgtctattaagtaacgggtttttctcaggctgtttttatagcatgctattttctccctgcagcatgcctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgagatataatgacaaaactcaacagaaaaatgaatgacagcaattcagcaggagcaggtggaccagtgaaaataacagaaaaccgatcaaagaagaccagtttctttcgttgctcgctactttgatgaactctttctgagagactgcagcacacctagagggccctttcctgcttctctgaaagcacaggtcacccagcctcagaatcacacctcccggctgctgctgagagcaccactgaacttagacctctcaacacagtatgccaagtggattccagcctcatggcctagcaaaagaacagactccctttttcaaacatggaagcaatgaagtggagacacatgcaggacctaactcgttttttccttgttttattacctgttgcagaagcggttatctttcttttttactttgcacatcagtgttagcctttccctatttcagcacaatcttagactcatatttgcacacttttgtgtcgtgaagttctagacaaatttgtacatgtggcaatgttaaaagagcatttacagcagaggttaatatactaaaattaaagggtatttggtctggttcatatggtcaaatattactgccttggtagcatttatttaagggctttttcttaaataagaatcattaaagtcattaaaaaaatttactgaaatgcccatcttgtcatcaaaggccacaatttctttatttcttcagattaagagctttgcctcatccccgacctgttttccagagtctgggtagctgaatgaatcactttaaaatgattacctctgcctaatctatagaaactgcatttggaaatcaccataatctcatttttccctggggtttgtatttgctattctttcccatgtttgacttaagtgtaatcactcttaagtaatatttgaacattattatctgtttctatttgtgaacttcttgagctgaaattttacgtgggctgagagatataccatttagggttttagtgcagcatctaactgtgattctgtcaataaggatatgtaatatattttttcttaggttcactccttagctggctggtttagttgtaataccaaattcctaccataatccctgtctacaaaagttaggtttagattttagtttgcggaaaccttccctatatagagacagattaacttgttgatataaatttaatagagctagctcttggtaatggtgaaaataatgagttttggttggttttatttggcagatgtttttagaaataaaagtacttagacctagtgcagcctctaggaaaagtcttgccttttcattagagaaaacaggaccaaggtttcagttttcaaacagctgttgttgaatgtgtagaacccagttccatctgttttggttcattgttacagaacttagtccagtcatttgggctaaagccaaccaaaagcttagttgcctttctcaacaaacactggtactggtatacttttgtagatgaaaccatcacaaggtatttagtgttaacttgtgtgccaaattcagatcactatgtcgttgttgctctagccttcagtgtcataacacaggggggataaaacagaggggatgagggaaatgaattctgttaataattattcttcctggtatgcctgttttgcttcacaaaggctactatcatgctggatagataagaacaggagatggcagtggaaagggattgcttgttaccacagagaattctcttcaaattaagatatgtcattagaatgcttggaccagtcaatcttttgtacttatttgaaaatataggaacaatttagcagctgcaaatatgcccaagctatttttaatagatatactaaacttattgttgacaaatttcagcctccttaatttttttttttttggtaattacctataggcttaaaagtcattcgttgctgttctagtataattagtagttccgtgattgaaagtttattgtaattctactatcttcaaattagatacattttcaaaaggaaaagataattttttagaaacatcttaatattcactatttcctgaaaaaatccaagcagttaacgctttctggatggtaacaaagtaccttctaaaagataagtgctatgacaccatgtatgaatgtaattctcttagtaatttacctctgactatttggtgtcttaacgctttggtttatataatctcaggggttgtctgcaaaccaaaactgacatattctgtggttagcttttattacttttttttttaacagaatgctttgctttggttatatttcttctttcttcttttgtcttatatggattaataactagtctccatgaacttcacttgaaagagcctgtaaaagttagatgagtctaaaagtgctctttgaagtagcagcaaattgggagtatatgctctgttatatagaaataaattgtccttgctattttcttacatttagctttgctagattgtatatacattgagctaagaccttaggaaattcactttctgcatgataaaatgacccaataaatattccactttgcttaataatgtacatacagtgcattattttttctatttgtagatgaatttaatgacagataattgtctgttccccgctgaaactgaagaaatctagtttttttgtgaacatttttgtggtcttatggataaggtacatgaagatttttgcagcagtattagtggttcagtggctgcactttattaatcagtgtgttaatttttgacagtgattggactagaccttttcaaatagagtctgagggtatcagacagtgaaaatgtgctgtaactaagtagcatgtaaatcagttgattgtaaaacgtttcgctgggaacttattttagctatattttacttcagacagattatgatacaataatctacctgtgcatcagttagtaggtgctgcagggtttcttactatttacagaaacattttgtgcagtctttgttataaattttcagaagactatactctttactttgaaggtctattttttaattatacctcatttagctaactagtattctaatacctggtagaaaaacagtgagccagcctttaagcatctaacaaaatttagactctttgttttgttttgaactgaagacatcattgggaaaggtaggaaatattagtttaggatagagcatacatgtcatatccagtagcataaaaaaagtattatctccctgtctccattaataaatttagctgtgcaatataggtgcgtttttgcagaagtttctagtaagagattataactccattttacaggttctgaatgctcagagtctatattaaggcttataaagtttttcctgtgatcagtaagtgacacatttaagcagacattcttttcaagttcatgacttagattcctttacaaatttagttctcaatctttaaaaaccacatttcattatgttggttaattattataaattttaagcactcatttctgcaatcaggtttctcagaattttttttttttaaacagaagagacattcctttttccttgttacatccaaggggggcacaggggtgggtggaaaggaatgtctaaaaatgaaatcccttgatatagagggacctagacggacaggatatgctaaaataatttcaaattctagcacaattttagagtagaataagtcatttttttagactaataaaattaatggctgtcatgttcactctgaaaaaaatctaaatgactgaaatgtacagaaataaaaattagcaaacaattattctagggatattttcagattttacttcatttcttgaaatgcgtgtgccatatgcaattgcatttcttgtgccaagaaactaatagaacttatttcactttacctttttttaaaatgtgaatttagttattatagttcaattttatggccttacagatggcttttattttgtttgcagctgacactgcagttcctttcatgcaaaataccataaactgtttgatgaaaatcatgcccctaatggaaactctctagtttttccatataactatcctactgtacatgtttaaacatattttatttttgctccaatggcttaatgtgaaaagctcctgcagataagtggacctgtcatgtggttaatcttgtttaagccaattcattaactgtgtactgatactgatgctatgttttttttaaatggattttattccaggtgaactttttttttataataatgttcgtctaaaataaaaactacataatgaaaatgaaaa

SEQ ID NO: 72067 - DNA, 4348 bp, Homo sapiens
gggtagaggggcagggcggggcaggcctgggaggaggggacggttcaggcttccttacacttgcacgaggaataatgacaaaactcaacagaaaaatgaatgacagcaattcagcaggagcaggtggaccagtgaaaataacagaaaaccgatcaaagaagaccagtttctttcgttgctcgctactttgatgaactctttctgagagactgcagcacacctagagggccctttcctgcttctctgaaagcacaggtcacccagcctcagaatcacacctcccggctgctgctgagagcaccactgaacttagacctctcaacacagtatgccaagtggattccagcctcatggcctagcaaaagaacagactccctttttcaaacatggaagcaatgaagtggagacacatgcaggacctaactcgttttttccttgttttattacctgttgcagaagcggttatctttcttttttactttgcacatcagtgttagcctttccctatttcagcacaatcttagactcatatttgcacacttttgtgtcgtgaagttctagacaaatttgtacatgtggcaatgttaaaagagcatttacagcagaggttaatatactaaaattaaagggtatttggtctggttcatatggtcaaatattactgccttggtagcatttatttaagggctttttcttaaataagaatcattaaagtcattaaaaaaatttactgaaatgcccatcttgtcatcaaaggccacaatttctttatttcttcagattaagagctttgcctcatccccgacctgttttccagagtctgggtagctgaatgaatcactttaaaatgattacctctgcctaatctatagaaactgcatttggaaatcaccataatctcatttttccctggggtttgtatttgctattctttcccatgtttgacttaagtgtaatcactcttaagtaatatttgaacattattatctgtttctatttgtgaacttcttgagctgaaattttacgtgggctgagagatataccatttagggttttagtgcagcatctaactgtgattctgtcaataaggatatgtaatatattttttcttaggttcactccttagctggctggtttagttgtaataccaaattcctaccataatccctgtctacaaaagttaggtttagattttagtttgcggaaaccttccctatatagagacagattaacttgttgatataaatttaatagagctagctcttggtaatggtgaaaataatgagttttggttggttttatttggcagatgtttttagaaataaaagtacttagacctagtgcagcctctaggaaaagtcttgccttttcattagagaaaacaggaccaaggtttcagttttcaaacagctgttgttgaatgtgtagaacccagttccatctgttttggttcattgttacagaacttagtccagtcatttgggctaaagccaaccaaaagcttagttgcctttctcaacaaacactggtactggtatacttttgtagatgaaaccatcacaaggtatttagtgttaacttgtgtgccaaattcagatcactatgtcgttgttgctctagccttcagtgtcataacacaggggggataaaacagaggggatgagggaaatgaattctgttaataattattcttcctggtatgcctgttttgcttcacaaaggctactatcatgctggatagataagaacaggagatggcagtggaaagggattgcttgttaccacagagaattctcttcaaattaagatatgtcattagaatgcttggaccagtcaatcttttgtacttatttgaaaatataggaacaatttagcagctgcaaatatgcccaagctatttttaatagatatactaaacttattgttgacaaatttcagcctccttaatttttttttttttggtaattacctataggcttaaaagtcattcgttgctgttctagtataattagtagttccgtgattgaaagtttattgtaattctactatcttcaaattagatacattttcaaaaggaaaagataattttttagaaacatcttaatattcactatttcctgaaaaaatccaagcagttaacgctttctggatggtaacaaagtaccttctaaaagataagtgctatgacaccatgtatgaatgtaattctcttagtaatttacctctgactatttggtgtcttaacgctttggtttatataatctcaggggttgtctgcaaaccaaaactgacatattctgtggttagcttttattacttttttttttaacagaatgctttgctttggttatatttcttctttcttcttttgtcttatatggattaataactagtctccatgaacttcacttgaaagagcctgtaaaagttagatgagtctaaaagtgctctttgaagtagcagcaaattgggagtatatgctctgttatatagaaataaattgtccttgctattttcttacatttagctttgctagattgtatatacattgagctaagaccttaggaaattcactttctgcatgataaaatgacccaataaatattccactttgcttaataatgtacatacagtgcattattttttctatttgtagatgaatttaatgacagataattgtctgttccccgctgaaactgaagaaatctagtttttttgtgaacatttttgtggtcttatggataaggtacatgaagatttttgcagcagtattagtggttcagtggctgcactttattaatcagtgtgttaatttttgacagtgattggactagaccttttcaaatagagtctgagggtatcagacagtgaaaatgtgctgtaactaagtagcatgtaaatcagttgattgtaaaacgtttcgctgggaacttattttagctatattttacttcagacagattatgatacaataatctacctgtgcatcagttagtaggtgctgcagggtttcttactatttacagaaacattttgtgcagtctttgttataaattttcagaagactatactctttactttgaaggtctattttttaattatacctcatttagctaactagtattctaatacctggtagaaaaacagtgagccagcctttaagcatctaacaaaatttagactctttgttttgttttgaactgaagacatcattgggaaaggtaggaaatattagtttaggatagagcatacatgtcatatccagtagcataaaaaaagtattatctccctgtctccattaataaatttagctgtgcaatataggtgcgtttttgcagaagtttctagtaagagattataactccattttacaggttctgaatgctcagagtctatattaaggcttataaagtttttcctgtgatcagtaagtgacacatttaagcagacattcttttcaagttcatgacttagattcctttacaaatttagttctcaatctttaaaaaccacatttcattatgttggttaattattataaattttaagcactcatttctgcaatcaggtttctcagaattttttttttttaaacagaagagacattcctttttccttgttacatccaaggggggcacaggggtgggtggaaaggaatgtctaaaaatgaaatcccttgatatagagggacctagacggacaggatatgctaaaataatttcaaattctagcacaattttagagtagaataagtcatttttttagactaataaaattaatggctgtcatgttcactctgaaaaaaatctaaatgactgaaatgtacagaaataaaaattagcaaacaattattctagggatattttcagattttacttcatttcttgaaatgcgtgtgccatatgcaattgcatttcttgtgccaagaaactaatagaacttatttcactttacctttttttaaaatgtgaatttagttattatagttcaattttatggccttacagatggcttttattttgtttgcagctgacactgcagttcctttcatgcaaaataccataaactgtttgatgaaaatcatgcccctaatggaaactctctagtttttccatataactatcctactgtacatgtttaaacatattttatttttgctccaatggcttaatgtgaaaagctcctgcagataagtggacctgtcatgtggttaatcttgtttaagccaattcattaactgtgtactgatactgatgctatgttttttttaaatggattttattccaggtgaactttttttttataataatgttcgtctaaaataaaaactacataatgaaaatgaaaa

SEQ ID NO: 72068 - DNA, 557 bp, Homo sapiens
ccgatttcttgtgccaagaaactaatagaacttatccaaataaaaattagcaaacaattattctagggatattttcagattttacttcatttcttgaaatgcgtgtgccatatgcaattgcatttcttgtgccaagaaactaatagaacttatttcactttacctttttttaaaatgtgaatttagttattatagttcaattttatggccttacagatggcttttattttgtttgcagctgacactgcagttcctttcatgcaaaataccataaactgtttgatgaaaatcatgcccctaatggaaactctctagtttttccatataactatcctactgtacatgtttaaacatattttatttttgctccaatggcttaatgtgaaaagctcctgcagataagtggacctgtcatgtggttaatcttgtttaagccaattcattaactgtgtactgatactgatgctatgttttttttaaatggattttattccaggtgaactttttttttataataatgttcgtctaaaataaaaactacataatgaaaatgaaaa

SEQ ID NO: 72069 - DNA, 4940 bp, Homo sapiens
acggggcggggcgcgcaggccttctccgagaggaggggcggggcgtggggcggggcgagcagcggcggattggcgggcacgccccctcgcccgcggccccctccccgcctctctccaccgcctcctctggctccccggtcagagggccggagcgagaagatggcgaagacgtacgattatctcttcaagctcctgctgatcggcgactcgggggtaggcaagacctgcctcctgttccgcttctcagaggacgccttcaacaccaccttcatctccaccatcggaattgattttaaaattagaacgatagaactagatggaaagaaaattaagcttcagatatgggacacagcgggtcaggaaagattccgaacaatcacgacagcgtactacagaggagccatgggcattatgctggtctatgacatcacaaatgaaaaatcctttgacaatattaaaaattggatcagaaacattgaagagcatgcctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgagatataatgacaaaactcaacagaaaaatgaatgacagcaattcagcaggagcaggtggaccagtgaaaataacagaaaaccgatcaaagaagaccagtttctttcgttgctcgctactttgatgaactctttctgagagactgcagcacacctagagggccctttcctgcttctctgaaagcacaggtcacccagcctcagaatcacacctcccggctgctgctgagagcaccactgaacttagacctctcaacacagtatgccaagtggattccagcctcatggcctagcaaaagaacagactccctttttcaaacatggaagcaatgaagtggagacacatgcaggacctaactcgttttttccttgttttattacctgttgcagaagcggttatctttcttttttactttgcacatcagtgttagcctttccctatttcagcacaatcttagactcatatttgcacacttttgtgtcgtgaagttctagacaaatttgtacatgtggcaatgttaaaagagcatttacagcagaggttaatatactaaaattaaagggtatttggtctggttcatatggtcaaatattactgccttggtagcatttatttaagggctttttcttaaataagaatcattaaagtcattaaaaaaatttactgaaatgcccatcttgtcatcaaaggccacaatttctttatttcttcagattaagagctttgcctcatccccgacctgttttccagagtctgggtagctgaatgaatcactttaaaatgattacctctgcctaatctatagaaactgcatttggaaatcaccataatctcatttttccctggggtttgtatttgctattctttcccatgtttgacttaagtgtaatcactcttaagtaatatttgaacattattatctgtttctatttgtgaacttcttgagctgaaattttacgtgggctgagagatataccatttagggttttagtgcagcatctaactgtgattctgtcaataaggatatgtaatatattttttcttaggttcactccttagctggctggtttagttgtaataccaaattcctaccataatccctgtctacaaaagttaggtttagattttagtttgcggaaaccttccctatatagagacagattaacttgttgatataaatttaatagagctagctcttggtaatggtgaaaataatgagttttggttggttttatttggcagatgtttttagaaataaaagtacttagacctagtgcagcctctaggaaaagtcttgccttttcattagagaaaacaggaccaaggtttcagttttcaaacagctgttgttgaatgtgtagaacccagttccatctgttttggttcattgttacagaacttagtccagtcatttgggctaaagccaaccaaaagcttagttgcctttctcaacaaacactggtactggtatacttttgtagatgaaaccatcacaaggtatttagtgttaacttgtgtgccaaattcagatcactatgtcgttgttgctctagccttcagtgtcataacacaggggggataaaacagaggggatgagggaaatgaattctgttaataattattcttcctggtatgcctgttttgcttcacaaaggctactatcatgctggatagataagaacaggagatggcagtggaaagggattgcttgttaccacagagaattctcttcaaattaagatatgtcattagaatgcttggaccagtcaatcttttgtacttatttgaaaatataggaacaatttagcagctgcaaatatgcccaagctatttttaatagatatactaaacttattgttgacaaatttcagcctccttaatttttttttttttggtaattacctataggcttaaaagtcattcgttgctgttctagtataattagtagttccgtgattgaaagtttattgtaattctactatcttcaaattagatacattttcaaaaggaaaagataattttttagaaacatcttaatattcactatttcctgaaaaaatccaagcagttaacgctttctggatggtaacaaagtaccttctaaaagataagtgctatgacaccatgtatgaatgtaattctcttagtaatttacctctgactatttggtgtcttaacgctttggtttatataatctcaggggttgtctgcaaaccaaaactgacatattctgtggttagcttttattacttttttttttaacagaatgctttgctttggttatatttcttctttcttcttttgtcttatatggattaataactagtctccatgaacttcacttgaaagagcctgtaaaagttagatgagtctaaaagtgctctttgaagtagcagcaaattgggagtatatgctctgttatatagaaataaattgtccttgctattttcttacatttagctttgctagattgtatatacattgagctaagaccttaggaaattcactttctgcatgataaaatgacccaataaatattccactttgcttaataatgtacatacagtgcattattttttctatttgtagatgaatttaatgacagataattgtctgttccccgctgaaactgaagaaatctagtttttttgtgaacatttttgtggtcttatggataaggtacatgaagatttttgcagcagtattagtggttcagtggctgcactttattaatcagtgtgttaatttttgacagtgattggactagaccttttcaaatagagtctgagggtatcagacagtgaaaatgtgctgtaactaagtagcatgtaaatcagttgattgtaaaacgtttcgctgggaacttattttagctatattttacttcagacagattatgatacaataatctacctgtgcatcagttagtaggtgctgcagggtttcttactatttacagaaacattttgtgcagtctttgttataaattttcagaagactatactctttactttgaaggtctattttttaattatacctcatttagctaactagtattctaatacctggtagaaaaacagtgagccagcctttaagcatctaacaaaatttagactctttgttttgttttgaactgaagacatcattgggaaaggtaggaaatattagtttaggatagagcatacatgtcatatccagtagcataaaaaaagtattatctccctgtctccattaataaatttagctgtgcaatataggtgcgtttttgcagaagtttctagtaagagattataactccattttacaggttctgaatgctcagagtctatattaaggcttataaagtttttcctgtgatcagtaagtgacacatttaagcagacattcttttcaagttcatgacttagattcctttacaaatttagttctcaatctttaaaaaccacatttcattatgttggttaattattataaattttaagcactcatttctgcaatcaggtttctcagaattttttttttttaaacagaagagacattcctttttccttgttacatccaaggggggcacaggggtgggtggaaaggaatgtctaaaaatgaaatcccttgatatagagggacctagacggacaggatatgctaaaataatttcaaattctagcacaattttagagtagaataagtcatttttttagactaataaaattaatggctgtcatgttcactctgaaaaaaatctaaatgactgaaatgtacagaaataaaaattagcaaacaattattctagggatattttcagattttacttcatttcttgaaatgcgtgtgccatatgcaattgcatttcttgtgccaagaaactaatagaacttatttcactttacctttttttaaaatgtgaatttagttattatagttcaattttatggccttacagatggcttttattttgtttgcagctgacactgcagttcctttcatgcaaaataccataaactgtttgatgaaaatcatgcccctaatggaaactctctagtttttccatataactatcctactgtacatgtttaaacatattttatttttgctccaatggcttaatgtgaaaagctcctgcagataagtggacctgtcatgtggttaatcttgtttaagccaattcattaactgtgtactgatactgatgctatgttttttttaaatggattttattccaggtgaactttttttttataataatgttcgtctaaaataaaaactacataatgaaaatgaaaa

SEQ ID NO: 72070 - DNA, 5191 bp, Homo sapiens
acggggcggggcgcgcaggccttctccgagaggaggggcggggcgtggggcggggcgagcagcggcggattggcgggcacgccccctcgcccgcggccccctccccgcctctctccaccgcctcctctggctccccggtcagagggccggagcgagaagatggcgaagacgtacgattatctcttcaagctcctgctgatcggcgactcgggggtaggcaagacctgcctcctgttccgcttctcagaggacgccttcaacaccaccttcatctccaccatcggaattgattttaaaattagaacgatagaactagatggaaagaaaattaagcttcagatatgggacacagcgggtcaggaaagattccgaacaatcacgacagcgtactacagaggagccatgggcattatgctggtctatgacatcacaaatgaaaaatcctttgacaatattaaaaattggatcagaaacattgaagagcatgcctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgagatataatgacaaaactcaacagaaaaatgaatgacagcaattcagcaggagcaggtggaccagtgaaaataacagaaaaccgatcaaagaagaccagtttctttcgttgctcgctactttgatgaactctttctgagagactgcagcacacctagagggccctttcctgcttctctgaaagcacaggtcacccagcctcagaatcacacctcccggctgctgctgagagcaccactgaacttagacctctcaacacagtatgccaagtggattccagcctcatggcctagcaaaagaacagactccctttttcaaacatggaagcaatgaagtggagacacatgcaggacctaactcgttttttccttgttttattacctgttgcagaagcggttatctttcttttttactttgcacatcagtgttagcctttccctatttcagcacaatcttagactcatatttgcacacttttgtgtcgtgaagttctagacaaatttgtacatgtggcaatgttaaaagagcatttacagcagaggttaatatactaaaattaaagggtatttggtctggttcatatggtcaaatattactgccttggtagcatttatttaagggctttttcttaaataagaatcattaaagtcattaaaaaaatttactgaaatgcccatcttgtcatcaaaggccacaatttctttatttcttcagattaagagctttgcctcatccccgacctgttttccagagtctgggtagctgaatgaatcactttaaaatgattacctctgcctaatctatagaaactgcatttggaaatcaccataatctcatttttccctggggtttgtatttgctattctttcccatgtttgacttaagtgtaatcactcttaagtaatatttgaacattattatctgtttctatttgtgaacttcttgagctgaaattttacgtgggctgagagatataccatttagggttttagtgcagcatctaactgtgattctgtcaataaggatatgtaatatattttttcttaggttcactccttagctggctggtttagttgtaataccaaattcctaccataatccctgtctacaaaagttaggtttagattttagtttgcggaaaccttccctatatagagacagattaacttgttgatataaatttaatagagctagctcttggtaatggtgaaaataatgagttttggttggttttatttggcagatgtttttagaaataaaagtacttagacctagtgcagcctctaggaaaagtcttgccttttcattagagaaaacaggaccaaggtttcagttttcaaacagctgttgttgaatgtgtagaacccagttccatctgttttggttcattgttacagaacttagtccagtcatttgggctaaagccaaccaaaagcttagttgcctttctcaacaaacactggtactggtatacttttgtagatgaaaccatcacaaggtatttagtgttaacttgtgtgccaaattcagatcactatgtcgttgttgctctagccttcagtgtcataacacaggggggataaaacagaggggatgagggaaatgaattctgttaataattattcttcctggtatgcctgttttgcttcacaaaggctactatcatgctggatagataagaacaggagatggcagtggaaagggattgcttgttaccacagagaattctcttcaaattaagatatgtcattagaatgcttggaccagtcaatcttttgtacttatttgaaaatataggaacaatttagcagctgcaaatatgcccaagctatttttaatagatatactaaacttattgttgacaaatttcagcctccttaatttttttttttttggtaattacctataggcttaaaagtcattcgttgctgttctagtataattagtagttccgtgattgaaagtttattgtaattctactatcttcaaattagatacattttcaaaaggaaaagataattttttagaaacatcttaatattcactatttcctgaaaaaatccaagcagttaacgctttctggatggtaacaaagtaccttctaaaagataagtgctatgacaccatgtatgaatgtaattctcttagtaatttacctctgactatttggtgtcttaacgctttggtttatataatctcaggggttgtctgcaaaccaaaactgacatattctgtggttagcttttattacttttttttttaacagaatgctttgctttggttatatttcttctttcttcttttgtcttatatggattaataactagtctccatgaacttcacttgaaagagcctgtaaaagttagatgagtctaaaagtgctctttgaagtagcagcaaattgggagtatatgctctgttatatagaaataaattgtccttgctattttcttacatttagctttgctagattgtatatacattgagctaagaccttaggaaattcactttctgcatgataaaatgacccaataaatattccactttgcttaataatgtacatacagtgcattattttttctatttgtagatgaatttaatgacagataattgtctgttccccgctgaaactgaagaaatctagtttttttgtgaacatttttgtggtcttatggataaggtacatgaagatttttgcagcagtattagtggttcagtggctgcactttattaatcagtgtgttaatttttgacagtgattggactagaccttttcaaatagagtctgagggtatcagacagtgaaaatgtgctgtaactaagtagcatgtaaatcagttgattgtaaaacgtttcgctgggaacttattttagctatattttacttcagacagattatgatacaataatctacctgtgcatcagttagtaggtgctgcagggtttcttactatttacagaaacattttgtgcagtctttgttataaattttcagaagactatactctttactttgaaggtctattttttaattatacctcatttagctaactagtattctaatacctggtagaaaaacagtgagccagcctttaagcatctaacaaaatttagactctttgttttgttttgaactgaagacatcattgggaaaggtaggaaatattagtttaggatagagcatacatgtcatatccagtagcataaaaaaagtattatctccctgtctccattaataaatttagctgtgcaatataggtgcgtttttgcagaagtttctagtaagagattataactccattttacaggttctgaatgctcagagtctatattaaggcttataaagtttttcctgtgatcagtaagtgacacatttaagcagacattcttttcaagttcatgacttagattcctttacaaatttagttctcaatctttaaaaaccacatttcattatgttggttaattattataaattttaagcactcatttctgcaatcaggtttctcagaattttttttttttaaacagaagagacattcctttttccttgttacatccaaggggggcacaggggtgggtggaaaggaatgtctaaaaatgaaatcccttgatatagagggacctagacggacaggatatgctaaaataatttcaaattctagcacaattttagagtagaataagtcatttttttagactaataaaattaatggctgtcatgttcactctgaaaaaaatctaaatgactgaaatgtacagaaataaaaattagcaaacaattattctagggatattttcagattttacttcatttcttgaaatgcgtgtgccatatgcaattgcatttcttgtgccaagaaactaatagaacttatttcactttacctttttttaaaatgtgaatttagttattatagttcaattttatggccttacagatggcttttattttgtttgcagctgacactgcagttcctttcatgcaaaataccataaactgtttgatgaaaatcatgcccctaatggaaactctctagtttttccatataactatcctactgtacatgtttaaacatattttatttttgctccaatggcttaatgtgaaaagctcctgcagataagtggacctgtcatgtggttaatcttgtttaagccaattcattaactgtgtactgatactgatgctatgttttttttaaatggattttattccaggtgaactttttttttataataatgttcgtctaaaataaaaactacataatgaaaatgaaaagacagtgacagacaacgcagctcacaccgacacccggagccgaccgcaccaccaccacggcgaaccacaactagcagcagcaaccagcgcgagcaaacgacaagcgacaccagcagcacccccacgcacggccccccagccggcagcgggcggcccacaaacacccgcccgagcaaccacagacacaggacacgacaccacacacgagcaccagcacgggacagcaccgccacccgcacacgaccaccgcc

SEQ ID NO: 72071 - DNA, 4886 bp, Homo sapiens
acggggcggggcgcgcaggccttctccgagaggaggggcggggcgtggggcggggcgagcagcggcggattggcgggcacgccccctcgcccgcggccccctccccgcctctctccaccgcctcctctggctccccggtcagagggccggagcgagaagatggcgaagacgtacgattatctcttcaagctcctgctgatcggcgactcgggggtaggcaagacctgcctcctgttccgcttctcagaggacgccttcaacaccaccttcatctccaccatcggaattgattttaaaattagaacgatagaactagatggaaagaaaattaagcttcagatatgggacacagcgggtcaggaaagattccgaacaatcacgacagcgtactacagaggagccatgggcattatgctggtctatgacatcacaaatgaaaaatcctttgacaatattaaaaattggatcagaaacattgaagagcatgcctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgagatataatgacaaaactcaacagaaaaatgaatgacagcaattcagcaggagcaggtggaccagtgaaaataacagtttctgagagactgcagcacacctagagggccctttcctgcttctctgaaagcacaggtcacccagcctcagaatcacacctcccggctgctgctgagagcaccactgaacttagacctctcaacacagtatgccaagtggattccagcctcatggcctagcaaaagaacagactccctttttcaaacatggaagcaatgaagtggagacacatgcaggacctaactcgttttttccttgttttattacctgttgcagaagcggttatctttcttttttactttgcacatcagtgttagcctttccctatttcagcacaatcttagactcatatttgcacacttttgtgtcgtgaagttctagacaaatttgtacatgtggcaatgttaaaagagcatttacagcagaggttaatatactaaaattaaagggtatttggtctggttcatatggtcaaatattactgccttggtagcatttatttaagggctttttcttaaataagaatcattaaagtcattaaaaaaatttactgaaatgcccatcttgtcatcaaaggccacaatttctttatttcttcagattaagagctttgcctcatccccgacctgttttccagagtctgggtagctgaatgaatcactttaaaatgattacctctgcctaatctatagaaactgcatttggaaatcaccataatctcatttttccctggggtttgtatttgctattctttcccatgtttgacttaagtgtaatcactcttaagtaatatttgaacattattatctgtttctatttgtgaacttcttgagctgaaattttacgtgggctgagagatataccatttagggttttagtgcagcatctaactgtgattctgtcaataaggatatgtaatatattttttcttaggttcactccttagctggctggtttagttgtaataccaaattcctaccataatccctgtctacaaaagttaggtttagattttagtttgcggaaaccttccctatatagagacagattaacttgttgatataaatttaatagagctagctcttggtaatggtgaaaataatgagttttggttggttttatttggcagatgtttttagaaataaaagtacttagacctagtgcagcctctaggaaaagtcttgccttttcattagagaaaacaggaccaaggtttcagttttcaaacagctgttgttgaatgtgtagaacccagttccatctgttttggttcattgttacagaacttagtccagtcatttgggctaaagccaaccaaaagcttagttgcctttctcaacaaacactggtactggtatacttttgtagatgaaaccatcacaaggtatttagtgttaacttgtgtgccaaattcagatcactatgtcgttgttgctctagccttcagtgtcataacacaggggggataaaacagaggggatgagggaaatgaattctgttaataattattcttcctggtatgcctgttttgcttcacaaaggctactatcatgctggatagataagaacaggagatggcagtggaaagggattgcttgttaccacagagaattctcttcaaattaagatatgtcattagaatgcttggaccagtcaatcttttgtacttatttgaaaatataggaacaatttagcagctgcaaatatgcccaagctatttttaatagatatactaaacttattgttgacaaatttcagcctccttaatttttttttttttggtaattacctataggcttaaaagtcattcgttgctgttctagtataattagtagttccgtgattgaaagtttattgtaattctactatcttcaaattagatacattttcaaaaggaaaagataattttttagaaacatcttaatattcactatttcctgaaaaaatccaagcagttaacgctttctggatggtaacaaagtaccttctaaaagataagtgctatgacaccatgtatgaatgtaattctcttagtaatttacctctgactatttggtgtcttaacgctttggtttatataatctcaggggttgtctgcaaaccaaaactgacatattctgtggttagcttttattacttttttttttaacagaatgctttgctttggttatatttcttctttcttcttttgtcttatatggattaataactagtctccatgaacttcacttgaaagagcctgtaaaagttagatgagtctaaaagtgctctttgaagtagcagcaaattgggagtatatgctctgttatatagaaataaattgtccttgctattttcttacatttagctttgctagattgtatatacattgagctaagaccttaggaaattcactttctgcatgataaaatgacccaataaatattccactttgcttaataatgtacatacagtgcattattttttctatttgtagatgaatttaatgacagataattgtctgttccccgctgaaactgaagaaatctagtttttttgtgaacatttttgtggtcttatggataaggtacatgaagatttttgcagcagtattagtggttcagtggctgcactttattaatcagtgtgttaatttttgacagtgattggactagaccttttcaaatagagtctgagggtatcagacagtgaaaatgtgctgtaactaagtagcatgtaaatcagttgattgtaaaacgtttcgctgggaacttattttagctatattttacttcagacagattatgatacaataatctacctgtgcatcagttagtaggtgctgcagggtttcttactatttacagaaacattttgtgcagtctttgttataaattttcagaagactatactctttactttgaaggtctattttttaattatacctcatttagctaactagtattctaatacctggtagaaaaacagtgagccagcctttaagcatctaacaaaatttagactctttgttttgttttgaactgaagacatcattgggaaaggtaggaaatattagtttaggatagagcatacatgtcatatccagtagcataaaaaaagtattatctccctgtctccattaataaatttagctgtgcaatataggtgcgtttttgcagaagtttctagtaagagattataactccattttacaggttctgaatgctcagagtctatattaaggcttataaagtttttcctgtgatcagtaagtgacacatttaagcagacattcttttcaagttcatgacttagattcctttacaaatttagttctcaatctttaaaaaccacatttcattatgttggttaattattataaattttaagcactcatttctgcaatcaggtttctcagaattttttttttttaaacagaagagacattcctttttccttgttacatccaaggggggcacaggggtgggtggaaaggaatgtctaaaaatgaaatcccttgatatagagggacctagacggacaggatatgctaaaataatttcaaattctagcacaattttagagtagaataagtcatttttttagactaataaaattaatggctgtcatgttcactctgaaaaaaatctaaatgactgaaatgtacagaaataaaaattagcaaacaattattctagggatattttcagattttacttcatttcttgaaatgcgtgtgccatatgcaattgcatttcttgtgccaagaaactaatagaacttatttcactttacctttttttaaaatgtgaatttagttattatagttcaattttatggccttacagatggcttttattttgtttgcagctgacactgcagttcctttcatgcaaaataccataaactgtttgatgaaaatcatgcccctaatggaaactctctagtttttccatataactatcctactgtacatgtttaaacatattttatttttgctccaatggcttaatgtgaaaagctcctgcagataagtggacctgtcatgtggttaatcttgtttaagccaattcattaactgtgtactgatactgatgctatgttttttttaaatggattttattccaggtgaactttttttttataataatgttcgtctaaaataaaaactacataatgaaaatgaaaa

SEQ ID NO: 72072 - DNA, 1238 bp, Homo sapiens
acggggcggggcgcgcaggccttctccgagaggaggggcggggcgtggggcggggcgagcagcggcggattggcgggcacgccccctcgcccgcggccccctccccgcctctctccaccgcctcctctggctccccggtcagagggccggagcgagaagatggcgaagacgtacgattatctcttcaagctcctgctgatcggcgactcgggggtaggcaagacctgcctcctgttccgcttctcagaggacgccttcaacaccaccttcatctccaccatcggaattgattttaaaattagaacgatagaactagatggaaagaaaattaagcttcagatatgggacacagcgggtcaggaaagattccgaacaatcacgacagcgtactacagaggagccatgggcattatgctggtctatgacatcacaaatgaaaaatcctttgacaatattaaaaattggatcagaaacattgaagagcatgcctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgagatataatgacaaaactcaacagaaaaatgaatgacagcaattcagcaggagcaggtggaccagtgaaaataacagaaaaccgatcaaagaagaccagtttctttcgttgctcgctactttgatgaactctttctgagagactgcagcacacctagagggccctttcctgcttctctgaaagcacaggtcacccagcctcagaatcacacctcccggctgctgctgagagcaccactgaacttagacctctcaacacagtatgccaagtggattccagcctcatggcctagcaaaagaacagactccctttttcaaacatggaagcaatgaagtggagacacatgcaggacctaactcgttttttccttgttttattacctgttgcagaagcggttatctttcttttttactttgcacatcagtgttagcctttccctatttcagcacaatcttagactcatatttgcacacttttgtgtcgtgaagttctagacaaatttgtacatgtggcaatgttaaaagagcatttacagcagaggttaatatactaaaattaaagggtatttggtctggttca

SEQ ID NO: 72073 - DNA, 1064 bp, Homo sapiens
cttctaaaaaggaagtaggggtgcgtgagaacgccggcggtgaccgcagccacagcggtgaccgagtgagaggaaggcggcggcggcggcggcggcggcggcgtgaagtcactgctgctctgggttcgggttggcgactgaaggcggtggaaatttaaaattgtttacagtcaacactgtttccagccatgggtttgtctccatctgctcctgctgttgcagttcaggcctcaaatgcttcagcgtccccaccttcaggatgcccgatgcatgaagggaaaatgaaaggctgtccagtgaatacagagccatctggcccaacctgtgagaagaaaacatactctgtgcctgcccaccaggaacgcgcctatgagtacgtggagtgtcccattaggggcactgcggctgagaataaggagaacctagatccttcaaatctgatgccaccaccaaatcaaacaccagctccagatcagccatttgcattgtctactgtcagagaagagtcatccattccgagagcagattcagagaaaaagtgggtttacccttctgagcagatgttctggaatgcaatgttaaagaaagggtggaagtggaaggatgaggatatcagtcagaaggatatgtataatatcattagaattcacaatcagaataacgagcaggcttggaaggagattttgaagtgggaagcccttcatgctgcagagtgtccttgtggtccatcattgatccggtttggagggaaagcaaaagagtattcaccaagggcacgaattcgttcctggatggggtatgagttgccttttgataggcacgattggatcataaaccgttgcgggacagaagttagatatgtgattgattattatgatggtggtgaagtcaacaaggactaccagttcaccatcctggacgtccgtcctgccttagattcactttcggcagtatgggacagaatgaaagtcgcttggtggcgttggacctcgtaaagcactgtttcagatggaaaaatataaactatttttttctgagcgatacattaaactattttccccaga

SEQ ID NO: 72074 - DNA, 858 bp, Homo sapiens
cttctaaaaaggaagtaggggtgcgtgagaacgccggcggtgaccgcagccacagcggtgaccgagtgagaggaaggcggcggcggcggcggcggcggcggcgtgaagtcactgctgctctgggttcgggttggcgactgaaggcggtaccggcctcccggaacagcccgggggagggcttaggtgcagaagggcaggctggccgcggccggtttggtctggggaccacgggctggagcaggtggaaatttaaaattgtttacagtcaacactgtttccagccatgggtttgtctccatctgctcctgctgttgcagttcaggcctcaaatgcttcagcgtccccaccttcaggatgcccgatgcatgaagggaaaatgaaaggctgtccagtgaatacagagccatctggcccaacctgtgagaagaaaacatactctgtgcctgcccaccaggaacgcgcctatgagtacgtggagtgtcccattaggggcactgcggctgagaataaggagaacctagatccttcaaatctgatgccaccaccaaatcaaacaccagctccagatcagccatttgcattgtctactgtcagagaagagtcatccattccgagagcagattcagagaaaaagtgggtttacccttctgagcagatgttctggaatgcaatgttaaagaaagggtggaagtggaaggatgaggatatcagtcagaaggatatgtataatatcattagaattcacaatcagaataacgagcaggcttggaaggagattttgaagtgggaagcccttcatgctgcgtaagtatgtttgagatcttaaatgtttcaagcatctttgttatttcatatcag

SEQ ID NO: 72075 - DNA, 2278 bp, Homo sapiens
cttctaaaaaggaagtaggggtgcgtgagaacgccggcggtgaccgcagccacagcggtgaccgagtgagaggaaggcggcggcggcggcggcggcggcggcgtgaagtcactgctgctctgggttcgggttggcgactgaaggcggtggaaatttaaaattgtttacagtcaacactgtttccagccatgggtttgtctccatctgctcctgctgttgcagttcaggcctcaaatgcttcagcgtccccaccttcaggatgcccgatgcatgaagggaaaatgaaaggctgtccagtgaatacagagccatctggcccaacctgtgagaagaaaacatactctgtgcctgcccaccaggaacgcgcctatgagtacgtggagtgtcccattaggggcactgcggctgagaataaggagaacctagatccttcaaatctgatgccaccaccaaatcaaacaccagctccagatcagccatttgcattgtctactgtcagagaagagtcatccattccgagagcagattcagagaaaaagtgggtttacccttctgagcagatgttctggaatgcaatgttaaagaaagggtggaagtggaaggatgaggatatcagtcagaaggatatgtataatatcattagaattcacaatcagaataacgagcaggcttggaaggagattttgaagtgggaagcccttcatgctgcagagtgtccttgtggtccatcattgatccggtttggagggaaagcaaaagagtattcaccaagggcacgaattcgttcctggatggggtatgagttgccttttgataggcacgattggatcataaaccgttgcgggacagaagttagatatgtgattgattattatgatggtggtgaagtcaacaaggactaccagttcaccatcctggacgtccgtcctgccttagattcactttcggcagtatgggacagaatgaaagtcgcttggtggcgttggacctcgtaaagcactgtttcagatggaaaaatataaactatttttttctgagcgatacattaaactattttccccagattgaattgcactcatgatgtaatgggaacttcaagtgggtaatcacactttttccttcacttaacgaaggatactatgcactgttcacttttgacttgtgttgtaccttgcagtttatagcagatcattttgttttcttcctacttagcttaagtgggaagcagtctctcagtttttcctttacctgcagtattgtctgtatatttcatctcgaaaagcctgaacaacctctgaaaaagagcttttaaaaagtgatgaaagttgcttttttttcttactattttctcaggaatactccagagatgtaaagcctgagagtccatggtgatgctcaagagctttcatctggccaaatattttaactaaagctgttcattataaataagaggtgattataccttttttaaaaaaagttaccattatttctaaagcccctatggtatgattgtgacctttaacaaaatgcaaaggtatacactggaaaggtactcagcaaaattctctccaaattctgatttatatgaatttcttggactggatagagtactttcaactataccttcctttggaacataccttttaaaaaatgttccctttaaatcctgttattctaatatgtaactctgctcccaacaaacaggtctcctcattgtccttggcatttgacaagttatcccaacttcgaatctcatttcttcctttgctggcagcctccacccttccccacatcagtcggcctaatccaaaccttgaaagcctggcttaagtcccagtatcagtgatggtccccctctaaaacatgattttatatttggctgagtgttaaaattcacaagatgagcatttttttcccagatggagaacgcttcaactcagtctagattttttttgtttgttttaaggaagctctaagtttgccattgaaactttttgtaccagtaatccataaactggttgttctatttatagcagcatgttacaaatgactgctttttttttttaactgtctatactattaaatcctttaatttatcctgaatgctgtagtgttaaattagtggatgaaattggcagtctgtgggtgattaatttggtatggatttgtcagttttgtgtggagtttaagaaatagaacagccttaaactctacatttcaaaatacttgtatattttaaaataaagctgattagttcacaggttttgaaaaaaaaatg

SEQ ID NO: 72076 - DNA, 2142 bp, Homo sapiens
tagttcagttcttgatagatttaaacagaagaaacctggcttttcctatggtggtaatcattggtcagaaattcagctctttagtgctccaattgagagagttagatgtcctgccttcatggtgacaccatttttatacttgattatttcaggctgtccagtgaatacagagccatctggcccaacctgtgagaagaaaacatactctgtgcctgcccaccaggaacgcgcctatgagtacgtggagtgtcccattaggggcactgcggctgagaataaggagaacctagatccttcaaatctgatgccaccaccaaatcaaacaccagctccagatcagccatttgcattgtctactgtcagagaagagtcatccattccgagagcagattcagagaaaaagtgggtttacccttctgagcagatgttctggaatgcaatgttaaagaaagggtggaagtggaaggatgaggatatcagtcagaaggatatgtataatatcattagaattcacaatcagaataacgagcaggcttggaaggagattttgaagtgggaagcccttcatgctgcagagtgtccttgtggtccatcattgatccggtttggagggaaagcaaaagagtattcaccaagggcacgaattcgttcctggatggggtatgagttgccttttgataggcacgattggatcataaaccgttgcgggacagaagttagatatgtgattgattattatgatggtggtgaagtcaacaaggactaccagttcaccatcctggacgtccgtcctgccttagattcactttcggcagtatgggacagaatgaaagtcgcttggtggcgttggacctcgtaaagcactgtttcagatggaaaaatataaactatttttttctgagcgatacattaaactattttccccagattgaattgcactcatgatgtaatgggaacttcaagtgggtaatcacactttttccttcacttaacgaaggatactatgcactgttcacttttgacttgtgttgtaccttgcagtttatagcagatcattttgttttcttcctacttagcttaagtgggaagcagtctctcagtttttcctttacctgcagtattgtctgtatatttcatctcgaaaagcctgaacaacctctgaaaaagagcttttaaaaagtgatgaaagttgcttttttttcttactattttctcaggaatactccagagatgtaaagcctgagagtccatggtgatgctcaagagctttcatctggccaaatattttaactaaagctgttcattataaataagaggtgattataccttttttaaaaaaagttaccattatttctaaagcccctatggtatgattgtgacctttaacaaaatgcaaaggtatacactggaaaggtactcagcaaaattctctccaaattctgatttatatgaatttcttggactggatagagtactttcaactataccttcctttggaacataccttttaaaaaatgttccctttaaatcctgttattctaatatgtaactctgctcccaacaaacaggtctcctcattgtccttggcatttgacaagttatcccaacttcgaatctcatttcttcctttgctggcagcctccacccttccccacatcagtcggcctaatccaaaccttgaaagcctggcttaagtcccagtatcagtgatggtccccctctaaaacatgattttatatttggctgagtgttaaaattcacaagatgagcatttttttcccagatggagaacgcttcaactcagtctagattttttttgtttgttttaaggaagctctaagtttgccattgaaactttttgtaccagtaatccataaactggttgttctatttatagcagcatgttacaaatgactgctttttttttttaactgtctatactattaaatcctttaatttatcctgaatgctgtagtgttaaattagtggatgaaattggcagtctgtgggtgattaatttggtatggatttgtcagttttgtgtggagtttaagaaatagaacagccttaaactctacatttcaaaatacttgtatattttaaaataaagctgattagttcacaggttttgaaaaaaaaatg

SEQ ID NO: 72077 - DNA, 1159 bp, Homo sapiens
cttctaaaaaggaagtaggggtgcgtgagaacgccggcggtgaccgcagccacagcggtgaccgagtgagaggaaggcggcggcggcggcggcggcggcggcgtgaagtcactgctgctctgggttcgggttggcgactgaaggcggtaccggcctcccggaacagcccgggggagggcttaggtgcagaagggcaggctggccgcggccggtttggtctggggaccacgggctggagcaggtggaaatttaaaattgtttacagtcaacactgtttccagccatgggtttgtctccatctgctcctgctgttgcagttcaggcctcaaatgcttcagcgtccccaccttcaggatgcccgatgcatgaagggaaaatgaaaggctgtccagtgaatacagagccatctggcccaacctgtgagaagaaaacatactctgtgcctgcccaccaggaacgcgcctatgagtacgtggagtgtcccattaggggcactgcggctgagaataaggagaacctagatccttcaaatctgatgccaccaccaaatcaaacaccagctccagatcagccatttgcattgtctactgtcagagaagagtcatccattccgagagcagattcagagaaaaagtgggtttacccttctgagcagatgttctggaatgcaatgttaaagaaagggtggaagtggaaggatgaggatatcagtcagaaggatatgtataatatcattagaattcacaatcagaataacgagcaggcttggaaggagattttgaagtgggaagcccttcatgctgcagagtgtccttgtggtccatcattgatccggtttggagggaaagcaaaagagtattcaccaagggcacgaattcgttcctggatggggtatgagttgccttttgataggcacgattggatcataaaccgttgcgggacagaagttagatatgtgattgattattatgatggtggtgaagtcaacaaggactaccagttcaccatcctggacgtccgtcctgccttagattcactttcggcagtatgggacagaatgaaagtcgcttggtggcgttggacctcgtaaagcactgtttcagatggaaaaatataaactatttttttctgagcgatacattaaactattttccccaga

SEQ ID NO: 72078 - DNA, 2373 bp, Homo sapiens
cttctaaaaaggaagtaggggtgcgtgagaacgccggcggtgaccgcagccacagcggtgaccgagtgagaggaaggcggcggcggcggcggcggcggcggcgtgaagtcactgctgctctgggttcgggttggcgactgaaggcggtaccggcctcccggaacagcccgggggagggcttaggtgcagaagggcaggctggccgcggccggtttggtctggggaccacgggctggagcaggtggaaatttaaaattgtttacagtcaacactgtttccagccatgggtttgtctccatctgctcctgctgttgcagttcaggcctcaaatgcttcagcgtccccaccttcaggatgcccgatgcatgaagggaaaatgaaaggctgtccagtgaatacagagccatctggcccaacctgtgagaagaaaacatactctgtgcctgcccaccaggaacgcgcctatgagtacgtggagtgtcccattaggggcactgcggctgagaataaggagaacctagatccttcaaatctgatgccaccaccaaatcaaacaccagctccagatcagccatttgcattgtctactgtcagagaagagtcatccattccgagagcagattcagagaaaaagtgggtttacccttctgagcagatgttctggaatgcaatgttaaagaaagggtggaagtggaaggatgaggatatcagtcagaaggatatgtataatatcattagaattcacaatcagaataacgagcaggcttggaaggagattttgaagtgggaagcccttcatgctgcagagtgtccttgtggtccatcattgatccggtttggagggaaagcaaaagagtattcaccaagggcacgaattcgttcctggatggggtatgagttgccttttgataggcacgattggatcataaaccgttgcgggacagaagttagatatgtgattgattattatgatggtggtgaagtcaacaaggactaccagttcaccatcctggacgtccgtcctgccttagattcactttcggcagtatgggacagaatgaaagtcgcttggtggcgttggacctcgtaaagcactgtttcagatggaaaaatataaactatttttttctgagcgatacattaaactattttccccagattgaattgcactcatgatgtaatgggaacttcaagtgggtaatcacactttttccttcacttaacgaaggatactatgcactgttcacttttgacttgtgttgtaccttgcagtttatagcagatcattttgttttcttcctacttagcttaagtgggaagcagtctctcagtttttcctttacctgcagtattgtctgtatatttcatctcgaaaagcctgaacaacctctgaaaaagagcttttaaaaagtgatgaaagttgcttttttttcttactattttctcaggaatactccagagatgtaaagcctgagagtccatggtgatgctcaagagctttcatctggccaaatattttaactaaagctgttcattataaataagaggtgattataccttttttaaaaaaagttaccattatttctaaagcccctatggtatgattgtgacctttaacaaaatgcaaaggtatacactggaaaggtactcagcaaaattctctccaaattctgatttatatgaatttcttggactggatagagtactttcaactataccttcctttggaacataccttttaaaaaatgttccctttaaatcctgttattctaatatgtaactctgctcccaacaaacaggtctcctcattgtccttggcatttgacaagttatcccaacttcgaatctcatttcttcctttgctggcagcctccacccttccccacatcagtcggcctaatccaaaccttgaaagcctggcttaagtcccagtatcagtgatggtccccctctaaaacatgattttatatttggctgagtgttaaaattcacaagatgagcatttttttcccagatggagaacgcttcaactcagtctagattttttttgtttgttttaaggaagctctaagtttgccattgaaactttttgtaccagtaatccataaactggttgttctatttatagcagcatgttacaaatgactgctttttttttttaactgtctatactattaaatcctttaatttatcctgaatgctgtagtgttaaattagtggatgaaattggcagtctgtgggtgattaatttggtatggatttgtcagttttgtgtggagtttaagaaatagaacagccttaaactctacatttcaaaatacttgtatattttaaaataaagctgattagttcacaggttttgaaaaaaaaatg

SEQ ID NO: 72079 - DNA, 2315 bp, Homo sapiens
cttctaaaaaggaagtaggggtgcgtgagaacgccggcggtgaccgcagccacagcggtgaccgagtgagaggaaggcggcggcggcggcggcggcggcggcgtgaagtcactgctgctctgggttcgggttggcgactgaaggcggtaccggcctcccggaacagcccgggggagggcttaggtggaaatttaaaattgtttacagtcaacactgtttccagccatgggtttgtctccatctgctcctgctgttgcagttcaggcctcaaatgcttcagcgtccccaccttcaggatgcccgatgcatgaagggaaaatgaaaggctgtccagtgaatacagagccatctggcccaacctgtgagaagaaaacatactctgtgcctgcccaccaggaacgcgcctatgagtacgtggagtgtcccattaggggcactgcggctgagaataaggagaacctagatccttcaaatctgatgccaccaccaaatcaaacaccagctccagatcagccatttgcattgtctactgtcagagaagagtcatccattccgagagcagattcagagaaaaagtgggtttacccttctgagcagatgttctggaatgcaatgttaaagaaagggtggaagtggaaggatgaggatatcagtcagaaggatatgtataatatcattagaattcacaatcagaataacgagcaggcttggaaggagattttgaagtgggaagcccttcatgctgcagagtgtccttgtggtccatcattgatccggtttggagggaaagcaaaagagtattcaccaagggcacgaattcgttcctggatggggtatgagttgccttttgataggcacgattggatcataaaccgttgcgggacagaagttagatatgtgattgattattatgatggtggtgaagtcaacaaggactaccagttcaccatcctggacgtccgtcctgccttagattcactttcggcagtatgggacagaatgaaagtcgcttggtggcgttggacctcgtaaagcactgtttcagatggaaaaatataaactatttttttctgagcgatacattaaactattttccccagattgaattgcactcatgatgtaatgggaacttcaagtgggtaatcacactttttccttcacttaacgaaggatactatgcactgttcacttttgacttgtgttgtaccttgcagtttatagcagatcattttgttttcttcctacttagcttaagtgggaagcagtctctcagtttttcctttacctgcagtattgtctgtatatttcatctcgaaaagcctgaacaacctctgaaaaagagcttttaaaaagtgatgaaagttgcttttttttcttactattttctcaggaatactccagagatgtaaagcctgagagtccatggtgatgctcaagagctttcatctggccaaatattttaactaaagctgttcattataaataagaggtgattataccttttttaaaaaaagttaccattatttctaaagcccctatggtatgattgtgacctttaacaaaatgcaaaggtatacactggaaaggtactcagcaaaattctctccaaattctgatttatatgaatttcttggactggatagagtactttcaactataccttcctttggaacataccttttaaaaaatgttccctttaaatcctgttattctaatatgtaactctgctcccaacaaacaggtctcctcattgtccttggcatttgacaagttatcccaacttcgaatctcatttcttcctttgctggcagcctccacccttccccacatcagtcggcctaatccaaaccttgaaagcctggcttaagtcccagtatcagtgatggtccccctctaaaacatgattttatatttggctgagtgttaaaattcacaagatgagcatttttttcccagatggagaacgcttcaactcagtctagattttttttgtttgttttaaggaagctctaagtttgccattgaaactttttgtaccagtaatccataaactggttgttctatttatagcagcatgttacaaatgactgctttttttttttaactgtctatactattaaatcctttaatttatcctgaatgctgtagtgttaaattagtggatgaaattggcagtctgtgggtgattaatttggtatggatttgtcagttttgtgtggagtttaagaaatagaacagccttaaactctacatttcaaaatacttgtatattttaaaataaagctgattagttcacaggttttgaaaaaaaaatg

SEQ ID NO: 72080 - DNA, 1635 bp, Homo sapiens
gcggccgcctactactactactactgctcgaattcaagcttctaacgatgtacggggacatgctgcagagtgtccttgtggtccatcattgatccggtttggagggaaagcaaaagagtattcaccaagggcacgaattcgttcctggatggggtatgagttgccttttgataggcacgattggatcataaaccgttgcgggacagaagttagatatgtgattgattattatgatggtggtgaagtcaacaaggactaccagttcaccatcctggacgtccgtcctgccttagattcactttcggcagtatgggacagaatgaaagtcgcttggtggcgttggacctcgtaaagcactgtttcagatggaaaaatataaactatttttttctgagcgatacattaaactattttccccagattgaattgcactcatgatgtaatgggaacttcaagtgggtaatcacactttttccttcacttaacgaaggatactatgcactgttcacttttgacttgtgttgtaccttgcagtttatagcagatcattttgttttcttcctacttagcttaagtgggaagcagtctctcagtttttcctttacctgcagtattgtctgtatatttcatctcgaaaagcctgaacaacctctgaaaaagagcttttaaaaagtgatgaaagttgcttttttttcttactattttctcaggaatactccagagatgtaaagcctgagagtccatggtgatgctcaagagctttcatctggccaaatattttaactaaagctgttcattataaataagaggtgattataccttttttaaaaaaagttaccattatttctaaagcccctatggtatgattgtgacctttaacaaaatgcaaaggtatacactggaaaggtactcagcaaaattctctccaaattctgatttatatgaatttcttggactggatagagtactttcaactataccttcctttggaacataccttttaaaaaatgttccctttaaatcctgttattctaatatgtaactctgctcccaacaaacaggtctcctcattgtccttggcatttgacaagttatcccaacttcgaatctcatttcttcctttgctggcagcctccacccttccccacatcagtcggcctaatccaaaccttgaaagcctggcttaagtcccagtatcagtgatggtccccctctaaaacatgattttatatttggctgagtgttaaaattcacaagatgagcatttttttcccagatggagaacgcttcaactcagtctagattttttttgtttgttttaaggaagctctaagtttgccattgaaactttttgtaccagtaatccataaactggttgttctatttatagcagcatgttacaaatgactgctttttttttttaactgtctatactattaaatcctttaatttatcctgaatgctgtagtgttaaattagtggatgaaattggcagtctgtgggtgattaatttggtatggatttgtcagttttgtgtggagtttaagaaatagaacagccttaaactctacatttcaaaatacttgtatattttaaaataaagctgattagttcacaggttttgaaaaaaaaatg

SEQ ID NO: 72081 - DNA, 5724 bp, Homo sapiens
gctgccgtgggctgcgcggggcccgcggtgtgtagagtccgccgccccggagccgcgtcccgcacccggacggtcccgagccatgggggtgttgatgtccaagcggcagacagtggagcaggtgcagaaggtgagtctggctgtgtctgctttcaaggatgggctgcgggacaggccttccatccgacgcacaggtgagctgccagggtcccgccgtggcactgtagagggctccgtccaggaggtacaggaggagaaggaagcagaagcaggaacctcggtggtccaggaagagagtagtgccggccgcgcagcctgggagcggctccgagatgggcgcggcgtggagcctgaggagtttgacaggacaagtcgattcacaccccctgcgttcatccgccccacccggaagctggatgatgacaaacctccagaaatctgcctggagcccagagagcctgttgtcaacgatgagatgtgtgatgtttgtgaggtctggacagctgagagcctcttcccgtgcagggtctgcaccagggttttccatgatggctgcctgcgccgcatgggctacatccaaggagacagtgcagcggaggtgacggagatggcccacacagaaacaggctggagctgccactactgtgacaacatcaacttgctgcttactgaggaggaaatgtatagcctcacggagacctttcagcggtgtaaagtcatccctgattgctccctgacactggaggactttctgcgttaccgccaccaagcagccaagcggggggaccgtgacagggccctgagtgaggagcaagaagagcaggcggcccgccagtttgctgccctggaccctgaacatcgaggccacatagagtggcctgacttcttgtcccatgagtccctcctgcttctgcagcagttgcgtccccagaactctctgttgaggcttctgacagtgaaggagcgggagcgagcccgagccgccttcctggctcggggcagtgggagcaccgtcagtgaggcagagtgccgccgggcccagcactcttggttttgcaaacggttcccagaggctccttcctgcagtgtcagcatcagccatgtgggtcccatcgcagatagcagcccagccagcagcagcagcaagagtcaggacaagaccctgctgcccacagagcaggagtccagatttgtggactggcctaccttcctgcaagagaatgtcctctacatcctggctgctcgccccaacagcgcagccattcacctgaagcccccaggatagcatggagcagagaagctcggtttgaggacagtgacatcctctccctcctttcctttctcccttcccccaccaacctctggcacagagactcatggggttgggacactgccagcgtcttaacttgtcactaagctttaaggcactgaaatcaccattcccctcacaatagaggcagtgaatgcattgccacaaggagaagccctgggagctgtggcagcatcctctcctggaccgcccctgccccacatcatagacgggacctgccaccacacttatatacatgtgcacatgctgcccagctgtccatgccttcagaagcctggttctttttggttgagaaaggaccaaagtccctttgtgaagcccctggtatagaggagggggtctctactcaccccttctataggcaggccagttctaatttccaatagataagtctctggccaagtgattcttaggaagggggcatgtcagactcgcatgcctgcctagagctcctggagatcctaatgggccccgctttctccaccaaaaatcccttctgcagtcagctgctgttactagtaggtgtgcattatgtacctcggctgtactgagttgggaaaagagttaaacatcaccactgaaattcagccctttatttatttaaattccaattcctggtgacagaaaaggcaactagcctggagaatcctgactggaagagggggaggcagcccttcccagggactcgggattctaggaacctctcagtcaggtcacctgagtccaaaagtctttagcagggtagtcaaaaatcaaggtgagccttcttggccccatttttcagatggtagctcatggcctagggccaagggggcctgaatggagcaaacacactggcaggagccacagccctctgtgttagatgcttcacccaagtcaccgaccacagagactgacgagagcacactctggaggaagaggagagaacggggctctgcttcctcatcattccagctcaactcaactgtagacaccttccacagcccaagaaagatctgcagagccctgagcagggactctttcagccatcctgacaaacaggataagaggctggggcttaagaagaggctctgcagagaaggtcctgggaaagccttacagaagttttccgcttctccctatcactgagactcggcttgagtggctgcttctcctcactgctcatcacatgtccttccccagcaggctagggcttgggcctggcatggaaggccttttggggcaatcagaggctgccacaagagcaccaagcctggcctccaagccccagccctccttcctaagtactcatcaaattcaaattcttcagtccgtgtgttatggctcatcttggccggccgtggggtccatgttctaggcttctgtttccaacttaatgacttaggcatagcgagatctgactaccaagagttattcaaaagggagtggagtgcagtcatgcagaagcaaacacgtcttcattgctcgaggcccttgtgctaaatcgggtgcgtacagaagaacacacaccgctcggtgctgaatgtttcgaggaaagcaaggagctgcggccaggggcttcttgagagccctgtgtagtctcctcctgtaggaaccaccttagctggaagcagggtggtgagctgctggggttggattatttgggactgaaatgaagcagacaggagacaaatctgggctcaggtgtatggcccacagcttttagaaatgctcttcagccgtcccccaggattgatccataggaggggccattattcagtctagtcaaaacaagaaagcgcaggactcctgggcctaagaactgcatctgaagcagccaggcctggggttttgcactgagatgaaagcacattaagcacaggggctcttacctactctcctggcaaatcatctcctgtgccactggccttgggctgctcgatctcacagacggggcattttgagtagagacaagctctgggctttgagagctgaatagcatttttctcctgcctcatcagtcacagggactggaagtccatcttgttccctgatccttcacagatcaaggtgatgcctacctctttggagctgctgcctctagctctccacgggtgagtgaggagagttggtgggccaggtcaggcctgccgtattccagggcctggcaaagcagccccagagttcttccacaacaggaacaggcccatttggatcacgcttctccctattccagaacagcaaacttcctgggtgagggcctgctacagagatcccaggggacacttccctcagcaaagagtagagttcccatcccacaagagtcctaggaagcaggaaagcacgaaggagcagccagcctcttctccacaggcagtcatctagctttttaccaaaggggaagtgccgttgctccccaagtccagagttgcagacgccctgccccaacccccgtccagaatctccctttgcagtgttctaatccccagagcccctctgcggtatgtatagagttgttaaaaacgttcagaaacccagtgaagcccatttcgttttcaagccctcccatcactgtgactctgaaattctgccaagtacaaatattagcgtttggctctaataagggtatgagaaaatgtttcagtcttttctttgtggctacccaaaattgagatcagtgtttctaaccaaggaaggcctgggttatagacaggctcctctgaagcccacttgccctaagcatttttcacctagcattcctcttcctcatgttcagatgtgaatgaaggggcagctggaggatgtggtggagctgcagggaccgagggtcagctgagcagtggccctggccacaaaaccactccaagtctgctccttggcttcctctcctgagcccagccttccccaacagaacacttgagcaagggcccctagagtatcccagggatggagcagtcccctcactctaggtactgatctaaccttcaagtgctcctcttcatttgaggacacctacagtagaaaccatgaggacattgcctctttctgccctcagcccaagtacctggggctagcagggcagataccagcctttctggtcctgctgctccctatgggatgtcaccctgaccttgcttaagtggccaagtcttagggtccccttattcctgtcaccattatgaaaaacacagcattaaactgcctgggaagaggacacctccttgggggagtgagccccaaggttatacccaggactcatagcccaaagcacaacctcggccattgcaggtttcacagcttcagtcagagtggtgccaggaagcccaaaagccaagagggaaggtcagcagaagctgcctggcaaggccccaggccagccaggcccaccccagagccaagagaaacttcaagcaggactgagaactggtagctggctctagtgatcctgaaagcatgttcccttcagaccagcagagtgaagacagacagatgtgtggccctaaaaggcagaacagttttgatgccagaacttcaggactgtcaccacagtccctttttacccctcctctatttacagtgaaataaaattcctattttctttttttttttttttttaattttccttatttcaagctcttatctgaaaaaatgctactttctcctaccacttagtttgaatttgcccaggatatctgtctgggcccctggctgcaacccagacaatggcgagatctcctggagtgggggatattcacgcatcgtgcctgttcctgacagctcagccctggtgtagggtgggactgggcattttctctgctgttacttttctgctaccactatttttgggaaccttggaaagaaaataaacaggttacagaatttcggctagcactaagggaaagctttttcctctgggccacatgccccagtgacccagagcatggaaagggggtcagctctggtctgggccagtgactaagaagcccaatcacattccagtttctatagcactgggtaggcacaacccacagttaagaacatcaagttataagtagccaggcctttccatagccatggtgacacaaaggccctcaagattagcctcctgccatcatgggttggcctgtgatctgtcccccagccaaacccaagtttgtgagagggactctgagaacacttgagtaacacttgggaatccaatgcgctctggtccctcatgcccttcccatgtgcttttctgcagaaggtaacttgacagcaagctgaggggaacgtccccaagccctgtctccctgtctctacagctgcatgctcctctgcgtggcccagccttcacagcgctccagaagaagctgatgccctgaggctgggcacagtggaaatcataataaagcgattgcgatgctcaaaaagct

SEQ ID NO: 72082 - DNA, 352 bp, Homo sapiens
aggaaaatatgataacgtcgaactacgggacaggacaggtcttaactgagcgactctcttaattttcaccgctacacgcatagcgagatctgactaccaagagttattcaaaagggagtggagtgcagtcatgcagaagcaaacacgtcttcattgctcgaggcccttgtgctaaatcggaaggtaacttgacagcaagctgaggggaacgtccccaagccctgtctccctgtctctacagctgcatgctcctctgcgtggcccagccttcacagcgctccagaagaagctgatgccctgaggctgggcacagtggaaatcataataaagcgattgcgatgctcaaaaagct

SEQ ID NO: 72083 - DNA, 5735 bp, Homo sapiens
  misc_feature (33)..(34): n is a, c, g, or t
  misc_feature (36)..(36): n is a, c, g, or t
cagaaaacggcgcatagggtaggctgggcagcnnanagattatgtgaaggttcgttgggaccctccggagccagtggggtactgcaaagagccatgggggtgttgatgtccaagcggcagacagtggagcaggtgcagaaggtgagtctggctgtgtctgctttcaaggatgggctgcgggacaggccttccatccgacgcacaggtgagctgccagggtcccgccgtggcactgtagagggctccgtccaggaggtacaggaggagaaggaagcagaagcaggaacctcggtggtccaggaagagagtagtgccggccgcgcagcctgggagcggctccgagatgggcgcggcgtggagcctgaggagtttgacaggacaagtcgattcacaccccctgcgttcatccgccccacccggaagctggatgatgacaaacctccagaaatctgcctggagcccagagagcctgttgtcaacgatgagatgtgtgatgtttgtgaggtctggacagctgagagcctcttcccgtgcagggtctgcaccagggttttccatgatggctgcctgcgccgcatgggctacatccaaggagacagtgcagcggaggtgacggagatggcccacacagaaacaggctggagctgccactactgtgacaacatcaacttgctgcttactgaggaggaaatgtatagcctcacggagacctttcagcggtgtaaagtcatccctgattgctccctgacactggaggactttctgcgttaccgccaccaagcagccaagcggggggaccgtgacagggccctgagtgaggagcaagaagagcaggcggcccgccagtttgctgccctggaccctgaacatcgaggccacatagagtggcctgacttcttgtcccatgagtccctcctgcttctgcagcagttgcgtccccagaactctctgttgaggcttctgacagtgaaggagcgggagcgagcccgagccgccttcctggctcggggcagtgggagcaccgtcagtgaggcagagtgccgccgggcccagcactcttggttttgcaaacggttcccagaggctccttcctgcagtgtcagcatcagccatgtgggtcccatcgcagatagcagcccagccagcagcagcagcaagagtcaggacaagaccctgctgcccacagagcaggagtccagatttgtggactggcctaccttcctgcaagagaatgtcctctacatcctggctgctcgccccaacagcgcagccattcacctgaagcccccaggatagcatggagcagagaagctcggtttgaggacagtgacatcctctccctcctttcctttctcccttcccccaccaacctctggcacagagactcatggggttgggacactgccagcgtcttaacttgtcactaagctttaaggcactgaaatcaccattcccctcacaatagaggcagtgaatgcattgccacaaggagaagccctgggagctgtggcagcatcctctcctggaccgcccctgccccacatcatagacgggacctgccaccacacttatatacatgtgcacatgctgcccagctgtccatgccttcagaagcctggttctttttggttgagaaaggaccaaagtccctttgtgaagcccctggtatagaggagggggtctctactcaccccttctataggcaggccagttctaatttccaatagataagtctctggccaagtgattcttaggaagggggcatgtcagactcgcatgcctgcctagagctcctggagatcctaatgggccccgctttctccaccaaaaatcccttctgcagtcagctgctgttactagtaggtgtgcattatgtacctcggctgtactgagttgggaaaagagttaaacatcaccactgaaattcagccctttatttatttaaattccaattcctggtgacagaaaaggcaactagcctggagaatcctgactggaagagggggaggcagcccttcccagggactcgggattctaggaacctctcagtcaggtcacctgagtccaaaagtctttagcagggtagtcaaaaatcaaggtgagccttcttggccccatttttcagatggtagctcatggcctagggccaagggggcctgaatggagcaaacacactggcaggagccacagccctctgtgttagatgcttcacccaagtcaccgaccacagagactgacgagagcacactctggaggaagaggagagaacggggctctgcttcctcatcattccagctcaactcaactgtagacaccttccacagcccaagaaagatctgcagagccctgagcagggactctttcagccatcctgacaaacaggataagaggctggggcttaagaagaggctctgcagagaaggtcctgggaaagccttacagaagttttccgcttctccctatcactgagactcggcttgagtggctgcttctcctcactgctcatcacatgtccttccccagcaggctagggcttgggcctggcatggaaggccttttggggcaatcagaggctgccacaagagcaccaagcctggcctccaagccccagccctccttcctaagtactcatcaaattcaaattcttcagtccgtgtgttatggctcatcttggccggccgtggggtccatgttctaggcttctgtttccaacttaatgacttaggcatagcgagatctgactaccaagagttattcaaaagggagtggagtgcagtcatgcagaagcaaacacgtcttcattgctcgaggcccttgtgctaaatcgggtgcgtacagaagaacacacaccgctcggtgctgaatgtttcgaggaaagcaaggagctgcggccaggggcttcttgagagccctgtgtagtctcctcctgtaggaaccaccttagctggaagcagggtggtgagctgctggggttggattatttgggactgaaatgaagcagacaggagacaaatctgggctcaggtgtatggcccacagcttttagaaatgctcttcagccgtcccccaggattgatccataggaggggccattattcagtctagtcaaaacaagaaagcgcaggactcctgggcctaagaactgcatctgaagcagccaggcctggggttttgcactgagatgaaagcacattaagcacaggggctcttacctactctcctggcaaatcatctcctgtgccactggccttgggctgctcgatctcacagacggggcattttgagtagagacaagctctgggctttgagagctgaatagcatttttctcctgcctcatcagtcacagggactggaagtccatcttgttccctgatccttcacagatcaaggtgatgcctacctctttggagctgctgcctctagctctccacgggtgagtgaggagagttggtgggccaggtcaggcctgccgtattccagggcctggcaaagcagccccagagttcttccacaacaggaacaggcccatttggatcacgcttctccctattccagaacagcaaacttcctgggtgagggcctgctacagagatcccaggggacacttccctcagcaaagagtagagttcccatcccacaagagtcctaggaagcaggaaagcacgaaggagcagccagcctcttctccacaggcagtcatctagctttttaccaaaggggaagtgccgttgctccccaagtccagagttgcagacgccctgccccaacccccgtccagaatctccctttgcagtgttctaatccccagagcccctctgcggtatgtatagagttgttaaaaacgttcagaaacccagtgaagcccatttcgttttcaagccctcccatcactgtgactctgaaattctgccaagtacaaatattagcgtttggctctaataagggtatgagaaaatgtttcagtcttttctttgtggctacccaaaattgagatcagtgtttctaaccaaggaaggcctgggttatagacaggctcctctgaagcccacttgccctaagcatttttcacctagcattcctcttcctcatgttcagatgtgaatgaaggggcagctggaggatgtggtggagctgcagggaccgagggtcagctgagcagtggccctggccacaaaaccactccaagtctgctccttggcttcctctcctgagcccagccttccccaacagaacacttgagcaagggcccctagagtatcccagggatggagcagtcccctcactctaggtactgatctaaccttcaagtgctcctcttcatttgaggacacctacagtagaaaccatgaggacattgcctctttctgccctcagcccaagtacctggggctagcagggcagataccagcctttctggtcctgctgctccctatgggatgtcaccctgaccttgcttaagtggccaagtcttagggtccccttattcctgtcaccattatgaaaaacacagcattaaactgcctgggaagaggacacctccttgggggagtgagccccaaggttatacccaggactcatagcccaaagcacaacctcggccattgcaggtttcacagcttcagtcagagtggtgccaggaagcccaaaagccaagagggaaggtcagcagaagctgcctggcaaggccccaggccagccaggcccaccccagagccaagagaaacttcaagcaggactgagaactggtagctggctctagtgatcctgaaagcatgttcccttcagaccagcagagtgaagacagacagatgtgtggccctaaaaggcagaacagttttgatgccagaacttcaggactgtcaccacagtccctttttacccctcctctatttacagtgaaataaaattcctattttctttttttttttttttttaattttccttatttcaagctcttatctgaaaaaatgctactttctcctaccacttagtttgaatttgcccaggatatctgtctgggcccctggctgcaacccagacaatggcgagatctcctggagtgggggatattcacgcatcgtgcctgttcctgacagctcagccctggtgtagggtgggactgggcattttctctgctgttacttttctgctaccactatttttgggaaccttggaaagaaaataaacaggttacagaatttcggctagcactaagggaaagctttttcctctgggccacatgccccagtgacccagagcatggaaagggggtcagctctggtctgggccagtgactaagaagcccaatcacattccagtttctatagcactgggtaggcacaacccacagttaagaacatcaagttataagtagccaggcctttccatagccatggtgacacaaaggccctcaagattagcctcctgccatcatgggttggcctgtgatctgtcccccagccaaacccaagtttgtgagagggactctgagaacacttgagtaacacttgggaatccaatgcgctctggtccctcatgcccttcccatgtgcttttctgcagaaggtaacttgacagcaagctgaggggaacgtccccaagccctgtctccctgtctctacagctgcatgctcctctgcgtggcccagccttcacagcgctccagaagaagctgatgccctgaggctgggcacagtggaaatcataataaagcgattgcgatgctcaaaaagct

SEQ ID NO: 72084 - DNA, 1544 bp, Homo sapiens
caggctggtacggtcccagcttgatcaccttccccaacagaacacttgagcaagggcccctagagtatcccagggatggagcagtcccctcactctaggtactgatctaaccttcaagtgctcctcttcatttgaggacacctacagtagaaaccatgaggacattgcctctttctgccctcagcccaagtacctggggctagcagggcagataccagcctttctggtcctgctgctccctatgggatgtcaccctgaccttgcttaagtggccaagtcttagggtccccttattcctgtcaccattatgaaaaacacagcattaaactgcctgggaagaggacacctccttgggggagtgagccccaaggttatacccaggactcatagcccaaagcacaacctcggccattgcaggtttcacagcttcagtcagagtggtgccaggaagcccaaaagccaagagggaaggtcagcagaagctgcctggcaaggccccaggccagccaggcccaccccagagccaagagaaacttcaagcaggactgagaactggtagctggctctagtgatcctgaaagcatgttcccttcagaccagcagagtgaagacagacagatgtgtggccctaaaaggcagaacagttttgatgccagaacttcaggactgtcaccacagtccctttttacccctcctctatttacagtgaaataaaattcctattttctttttttttttttttttaattttccttatttcaagctcttatctgaaaaaatgctactttctcctaccacttagtttgaatttgcccaggatatctgtctgggcccctggctgcaacccagacaatggcgagatctcctggagtgggggatattcacgcatcgtgcctgttcctgacagctcagccctggtgtagggtgggactgggcattttctctgctgttacttttctgctaccactatttttgggaaccttggaaagaaaataaacaggttacagaatttcggctagcactaagggaaagctttttcctctgggccacatgccccagtgacccagagcatggaaagggggtcagctctggtctgggccagtgactaagaagcccaatcacattccagtttctatagcactgggtaggcacaacccacagttaagaacatcaagttataagtagccaggcctttccatagccatggtgacacaaaggccctcaagattagcctcctgccatcatgggttggcctgtgatctgtcccccagccaaacccaagtttgtgagagggactctgagaacacttgagtaacacttgggaatccaatgcgctctggtccctcatgcccttcccatgtgcttttctgcagaaggtaacttgacagcaagctgaggggaacgtccccaagccctgtctccctgtctctacagctgcatgctcctctgcgtggcccagccttcacagcgctccagaagaagctgatgccctgaggctgggcacagtggaaatcataataaagcgattgcgatgctcaaaaagct

SEQ ID NO: 72085 - DNA, 4963 bp, Homo sapiens
  misc_feature (33)..(34): n is a, c, g, or t
  misc_feature (36)..(36): n is a, c, g, or t
cagaaaacggcgcatagggtaggctgggcagcnnanagattatgtgaaggttcgttgggaccctccggagccagtggggtactgcaaagagccatgggggtgttgatgtccaagcggcagacagtggagcaggtgcagaaggtgagtctggctgtgtctgctttcaaggatgggctgcgggacaggccttccatccgacgcacaggtgagctgccagggtcccgccgtggcactgtagagggctccgtccaggaggtacaggaggagaaggaagcagaagcaggaacctcggtggtccaggaagagagtagtgccggccgcgcagcctgggagcggctccgagatgggcgcggcgtggagcctgaggagtttgacaggacaagtcgattcacaccccctgcgttcatccgccccacccggaagctggatgatgacaaacctccagaaatctgcctggagcccagagagcctgttgtcaacgatgagatgtgtgatgtttgtgaggtctggacagctgagagcctcttcccgtgcagggtctgcaccagggttttccatgatggctgcctgcgccgcatgggctacatccaaggagacagtgcagcggaggtgacggagatggcccacacagaaacaggctggagctgccactactgtgacaacatcaacttgctgcttactgaggaggaaatgtatagcctcacggagacctttcagcggtgtaaagtcatccctgattgctccctgacactggaggactttctgcgttaccgccaccaagcagccaagcggggggaccgtgacagggccctgagtgaggagcaagaagagcaggcggcccgccagtttgctgccctggaccctgaacatcgaggccacatagagtggcctgacttcttgtcccatgagtccctcctgcttctgcagcagttgcgtccccagaactctctgttgaggcttctgacagtgaaggagcgggagcgagcccgagccgccttcctggctcggggcagtgggagcaccgtcagtgaggcagagtgccgccgggcccagcactcttggttttgcaaacggttcccagaggctccttcctgcagtgtcagcatcagccatgtgggtcccatcgcagatagcagcccagccagcagcagcagcaagagtcaggacaagaccctgctgcccacagagcaggagtccagatttgtggactggcctaccttcctgcaagagaatgtcctctacatcctggctgctcgccccaacagcgcagccattcacctgaagcccccaggatagcatggagcagagaagctcggtttgaggacagtgacatcctctccctcctttcctttctcccttcccccaccaacctctggcacagagactcatggggttgggacactgccagcgtcttaacttgtcactaagctttaaggcactgaaatcaccattcccctcacaatagaggcagtgaatgcattgccacaaggagaagccctgggagctgtggcagcatcctctcctggaccgcccctgccccacatcatagacgggacctgccaccacacttatatacatgtgcacatgctgcccagctgtccatgccttcagaagcctggttctttttggttgagaaaggaccaaagtccctttgtgaagcccctggtatagaggagggggtctctactcaccccttctataggcaggccagttctaatttccaatagataagtctctggccaagtgattcttaggaagggggcatgtcagactcgcatgcctgcctagagctcctggagatcctaatgggccccgctttctccaccaaaaatcccttctgcagtcagctgctgttactagtaggtgtgcattatgtacctcggctgtactgagttgggaaaagagttaaacatcaccactgaaattcagccctttatttatttaaattccaattcctggtgacagaaaaggcaactagcctggagaatcctgactggaagagggggaggcagcccttcccagggactcgggattctaggaacctctcagtcaggtcacctgagtccaaaagtctttagcagggtagtcaaaaatcaaggtgagccttcttggccccatttttcagatggtagctcatggcctagggccaagggggcctgaatggagcaaacacactggcaggagccacagccctctgtgttagatgcttcacccaagtcaccgaccacagagactgacgagagcacactctggaggaagaggagagaacggggctctgcttcctcatcattccagctcaactcaactgtagacaccttccacagcccaagaaagatctgcagagccctgagcagggactctttcagccatcctgacaaacaggataagaggctggggcttaagaagaggctctgcagagaaggtcctgggaaagccttacagaagttttccgcttctccctatcactgagactcggcttgagtggctgcttctcctcactgctcatcacatgtccttccccagcaggctagggcttgggcctggcatggaaggccttttggggcaatcagaggctgccacaagagcaccaagcctggcctccaagccccagccctccttcctaagtactcatcaaattcaaattcttcagtccgtgtgttatggctcatcttggccggccgtggggtccatgttctaggcttctgtttccaacttaatgacttaggcatagcgagatctgactaccaagagttattcaaaagggagtggagtgcagtcatgcagaagcaaacacgtcttcattgctcgaggcccttgtgctaaatcgggtgcgtacagaagaacacacaccgctcggtgctgaatgtttcgaggaaagcaaggagctgcggccaggggcttcttgagagccctgtgtagtctcctcctgtaggaaccaccttagctggaagcagggtggtgagctgctggggttggattatttgggactgaaatgaagcagacaggagacaaatctgggctcaggtgtatggcccacagcttttagaaatgctcttcagccgtcccccaggattgatccataggaggggccattattcagtctagtcaaaacaagaaagcgcaggactcctgggcctaagaactgcatctgaagcagccaggcctggggttttgcactgagatgaaagcacattaagcacaggggctcttacctactctcctggcaaatcatctcctgtgccactggccttgggctgctcgatctcacagacggggcattttgagtagagacaagctctgggctttgagagctgaatagcatttttctcctgcctcatcagtcacagggactggaagtccatcttgttccctgatccttcacagatcaaggtgatgcctacctctttggagctgctgcctctagctctccacgggtgagtgaggagagttggtgggccaggtcaggcctgccgtattccagggcctggcaaagcagccccagagttcttccacaacaggaacaggcccatttggatcacgcttctccctattccagaacagcaaacttcctgggtgagggcctgctacagagatcccaggggacacttccctcagcaaagagtagagttcccatcccacaagagtcctaggaagcaggaaagcacgaaggagcagccagcctcttctccacaggcagtcatctagctttttaccaaaggggaagtgccgttgctccccaagtccagagttgcagacgccctgccccaacccccgtccagaatctccctttgcagtgttctaatccccagagcccctctgcggtatgtatagagttgttaaaaacgttcagaaacccagtgaagcccatttcgttttcaagccctcccatcactgtgactctgaaattctgccaagtacaaatattagcgtttggctctaataagggtatgagaaaatgtttcagtcttttctttgtggctacccaaaattgagatcagtgtttctaaccaaggaaggcctgggttatagacaggctcctctgaagcccacttgccctaagcatttttcacctagcattcctcttcctcatgttcagatgtgaatgaaggggcagctggaggatgtggtggagctgcagggaccgagggtcagctgagcagtggccctggccacaaaaccactccaagtctgctccttggcttcctctcctgagcccagccttccccaacagaacacttgagcaagggcccctagagtatcccagggatggagcagtcccctcactctaggtactgatctaaccttcaagtgctcctcttcatttgaggacacctacagtagaaaccatgaggacattgcctctttctgccctcagcccaagtacctggggctagcagggcagataccagcctttctggtcctgctgctccctatgggatgtcaccctgaccttgcttaagtggccaagtcttagggtccccttattcctgtcaccattatgaaaaacacagcattaaactgcctgggaagaggacacctccttgggggagtgagccccaaggttatacccaggactcatagcccaaagcacaacctcggccattgcaggtttcacagcttcagtcagagtggtgccaggaagcccaaaagccaagagggaaggtcagcagaagctgcctggcaaggccccaggccagccaggcccaccccagagccaagagaaacttcaagcaggactgagaactggtagctggctctagtgatcctgaaagcatgttcccttcagaccagcagagtgaagacagacagatgtgtggccctaaaaggcagaacagttttgatgccagaacttcaggactgtcaccacagtccctttttacccctcctctatttacagtgaaataaaattcctattttcgttactgggtgttccaacctaaataatggtgctcatttcaaagct

SEQ ID NO: 72086 - DNA, 3745 bp, Homo sapiens
  misc_feature (33)..(34): n is a, c, g, or t
  misc_feature (36)..(36): n is a, c, g, or t
cagaaaacggcgcatagggtaggctgggcagcnnanagattatgtgaaggttcgttgggaccctccggagccagtggggtactgcaaagagccatgggggtgttgatgtccaagcggcagacagtggagcaggtgcagaaggtgagtctggctgtgtctgctttcaaggatgggctgcgggacaggccttccatccgacgcacaggtgagctgccagggtcccgccgtggcactgtagagggctccgtccaggaggtacaggaggagaaggaagcagaagcaggaacctcggtggtccaggaagagagtagtgccggccgcgcagcctgggagcggctccgagatgggcgcggcgtggagcctgaggagtttgacaggacaagtcgattcacaccccctgcgttcatccgccccacccggaagctggatgatgacaaacctccagaaatctgcctggagcccagagagcctgttgtcaacgatgagatgtgtgatgtttgtgaggtctggacagctgagagcctcttcccgtgcagggtctgcaccagggttttccatgatggctgcctgcgccgcatgggctacatccaaggagacagtgcagcggaggtgacggagatggcccacacagaaacaggctggagctgccactactgtgacaacatcaacttgctgcttactgaggaggaaatgtatagcctcacggagacctttcagcggtgtaaagtcatccctgattgctccctgacactggaggactttctgcgttaccgccaccaagcagccaagcggggggaccgtgacagggccctgagtgaggagcaagaagagcaggcggcccgccagtttgctgccctggaccctgaacatcgaggccacatagagtggcctgacttcttgtcccatgagtccctcctgcttctgcagcagttgcgtccccagaactctctgttgaggcttctgacagtgaaggagcgggagcgagcccgagccgccttcctggctcggggcagtgggagcaccgtcagtgaggcagagtgccgccgggcccagcactcttggttttgcaaacggttcccagaggctccttcctgcagtgtcagcatcagccatgtgggtcccatcgcagatagcagcccagccagcagcagcagcaagagtcaggacaagaccctgctgcccacagagcaggagtccagatttgtggactggcctaccttcctgcaagagaatgtcctctacatcctggctgctcgccccaacagcgcagccattcacctgaagcccccaggatagcatggagcagagaagctcggtttgaggacagtgacatcctctccctcctttcctttctcccttcccccaccaacctctggcacagagactcatggggttgggacactgccagcgtcttaacttgtcactaagctttaaggcactgaaatcaccattcccctcacaatagaggcagtgaatgcattgccacaaggagaagccctgggagctgtggcagcatcctctcctggaccgcccctgccccacatcatagacgggacctgccaccacacttatatacatgtgcacatgctgcccagctgtccatgccttcagaagcctggttctttttggttgagaaaggaccaaagtccctttgtgaagcccctggtatagaggagggggtctctactcaccccttctataggcaggccagttctaatttccaatagataagtctctggccaagtgattcttaggaagggggcatgtcagactcgcatgcctgcctagagctcctggagatcctaatgggccccgctttctccaccaaaaatcccttctgcagtcagctgctgttactagtaggtgtgcattatgtacctcggctgtactgagttgggaaaagagttaaacatcaccactgaaattcagccctttatttatttaaattccaattcctggtgacagaaaaggcaactagcctggagaatcctgactggaagagggggaggcagcccttcccagggactcgggattctaggaacctctcagtcaggtcacctgagtccaaaagtctttagcagggtagtcaaaaatcaaggtgagccttcttggccccatttttcagatggtagctcatggcctagggccaagggggcctgaatggagcaaacacactggcaggagccacagccctctgtgttagatgcttcacccaagtcaccgaccacagagactgacgagagcacactctggaggaagaggagagaacggggctctgcttcctcatcattccagctcaactcaactgtagacaccttccacagcccaagaaagatctgcagagccctgagcagggactctttcagccatcctgacaaacaggataagaggctggggcttaagaagaggctctgcagagaaggtcctgggaaagccttacagaagttttccgcttctccctatcactgagactcggcttgagtggctgcttctcctcactgctcatcacatgtccttccccagcaggctagggcttgggcctggcatggaaggccttttggggcaatcagaggctgccacaagagcaccaagcctggcctccaagccccagccctccttcctaagtactcatcaaattcaaattcttcagtccgtgtgttatggctcatcttggccggccgtggggtccatgttctaggcttctgtttccaacttaatgacttaggcatagcgagatctgactaccaagagttattcaaaagggagtggagtgcagtcatgcagaagcaaacacgtcttcattgctcgaggcccttgtgctaaatcgggtgcgtacagaagaacacacaccgctcggtgctgaatgtttcgaggaaagcaaggagctgcggccaggggcttcttgagagccctgtgtagtctcctcctgtaggaaccaccttagctggaagcagggtggtgagctgctggggttggattatttgggactgaaatgaagcagacaggagacaaatctgggctcaggtgtatggcccacagcttttagaaatgctcttcagccgtcccccaggattgatccataggaggggccattattcagtctagtcaaaacaagaaagcgcaggactcctgggcctaagaactgcatctgaagcagccaggcctggggttttgcactgagatgaaagcacattaagcacaggggctcttacctactctcctggcaaatcatctcctgtgccactggccttgggctgctcgatctcacagacggggcattttgagtagagacaagctctgggctttgagagctgaatagcatttttctcctgcctcatcagtcacagggactggaagtccatcttgttccctgatccttcacagatcaaggtgatgcctacctctttggagctgctgcctctagctctccacgggtgagtgaggagagttggtgggccaggtcaggcctgccgtattccagggcctggcaaagcagccccagagttcttccacaacaggaacaggcccatttggatcacgcttctccctattccagaacagcaaacttcctggaaggtaacttgacagcaagctgaggggaacgtccccaagccctgtctccctgtctctacagctgcatgctcctctgcgtggcccagccttcacagcgctccagaagaagctgatgccctgaggctgggcacagtggaaatcataataaagcgattgcgatgctcaaaaagct

SEQ ID NO: 72087 - DNA, 3545 bp, Homo sapiens
  misc_feature (33)..(34): n is a, c, g, or t
  misc_feature (36)..(36): n is a, c, g, or t
cagaaaacggcgcatagggtaggctgggcagcnnanagattatgtgaaggttcgttgggaccctccggagccagtggggtactgcaaagagccatgggggtgttgatgtccaagcggcagacagtggagcaggtgcagaaggtgagtctggctgtgtctgctttcaaggatgggctgcgggacaggccttccatccgacgcacaggtgagctgccagggtcccgccgtggcactgtagagggctccgtccaggaggtacaggaggagaaggaagcagaagcaggaacctcggtggtccaggaagagagtagtgccggccgcgcagcctgggagcggctccgagatgggcgcggcgtggagcctgaggagtttgacaggacaagtcgattcacaccccctgcgttcatccgccccacccggaagctggatgatgacaaacctccagaaatctgcctggagcccagagagcctgttgtcaacgatgagatgtgtgatgtttgtgaggtctggacagctgagagcctcttcccgtgcagggtctgcaccagggttttccatgatggctgcctgcgccgcatgggctacatccaaggagacagtgcagcggaggtgacggagatggcccacacagaaacaggctggagctgccactactgtgacaacatcaacttgctgcttactgaggaggaaatgtatagcctcacggagacctttcagcggtgtaaagtcatccctgattgctccctgacactggaggactttctgcgttaccgccaccaagcagccaagcggggggaccgtgacagggccctgagtgaggagcaagaagagcaggcggcccgccagtttgctgccctggaccctgaacatcgaggccacatagagtggcctgacttcttgtcccatgagtccctcctgcttctgcagcagttgcgtccccagaactctctgttgaggcttctgacagtgaaggagcgggagcgagcccgagccgccttcctggctcggggcagtgggagcaccgtcagtgaggcagagtgccgccgggcccagcactcttggttttgcaaacggttcccagaggctccttcctgcagtgtcagcatcagccatgtgggtcccatcgcagatagcagcccagccagcagcagcagcaagagtcaggacaagaccctgctgcccacagagcaggagtccagatttgtggactggcctaccttcctgcaagagaatgtcctctacatcctggctgctcgccccaacagcgcagccattcacctgaagcccccaggatagcatggagcagagaagctcggtttgaggacagtgacatcctctccctcctttcctttctcccttcccccaccaacctctggcacagagactcatggggttgggacactgccagcgtcttaacttgtcactaagctttaaggcactgaaatcaccattcccctcacaatagaggcagtgaatgcattgccacaaggagaagccctgggagctgtggcagcatcctctcctggaccgcccctgccccacatcatagacgggacctgccaccacacttatatacatgtgcacatgctgcccagctgtccatgccttcagaagcctggttctttttggttgagaaaggaccaaagtccctttgtgaagcccctggtatagaggagggggtctctactcaccccttctataggcaggccagttctaatttccaatagataagtctctggccaagtgattcttaggaagggggcatgtcagactcgcatgcctgcctagagctcctggagatcctaatgggccccgctttctccaccaaaaatcccttctgcagtcagctgctgttactagtaggtgtgcattatgtacctcggctgtactgagttgggaaaagagttaaacatcaccactgaaattcagccctttatttatttaaattccaattcctggtgacagaaaaggcaactagcctggagaatcctgactggaagagggggaggcagcccttcccagggactcgggattctaggaacctctcagtcaggtcacctgagtccaaaagtctttagcagggtagtcaaaaatcaaggtgagccttcttggccccatttttcagatggtagctcatggcctagggccaagggggcctgaatggagcaaacacactggcaggagccacagccctctgtgttagatgcttcacccaagtcaccgaccacagagactgacgagagcacactctggaggaagaggagagaacggggctctgcttcctcatcattccagctcaactcaactgtagacaccttccacagcccaagaaagatctgcagagccctgagcagggactctttcagccatcctgacaaacaggataagaggctggggcttaagaagaggctctgcagagaaggtcctgggaaagccttacagaagttttccgcttctccctatcactgagactcggcttgagtggctgcttctcctcactgctcatcacatgtccttccccagcaggctagggcttgggcctggcatggaaggccttttggggcaatcagaggctgccacaagagcaccaagcctggcctccaagccccagccctccttcctaagtactcatcaaattcaaattcttcagtccgtgtgttatggctcatcttggccggccgtggggtccatgttctaggcttctgtttccaacttaatgacttaggcatagcgagatctgactaccaagagttattcaaaagggagtggagtgcagtcatgcagaagcaaacacgtcttcattgctcgaggcccttgtgctaaatcgggtgcgtacagaagaacacacaccgctcggtgctgaatgtttcgaggaaagcaaggagctgcggccaggggcttcttgagagccctgtgtagtctcctcctgtaggaaccaccttagctggaagcagggtggtgagctgctggggttggattatttgggactgaaatgaagcagacaggagacaaatctgggctcaggtgtatggcccacagcttttagaaatgctcttcagccgtcccccaggattgatccataggaggggccattattcagtctagtcaaaacaagaaagcgcaggactcctgggcctaagaactgcatctgaagcagccaggcctggggttttgcactgagatgaaagcacattaagcacaggggctcttacctactctcctggcaaatcatctcctgtgccactggccttgggctgctcgatctcacagacggggcattttgagtagagacaagctctgggctttgagagctgaatagcatttttctcctgcctcatcagtcacagggactggaagtccatcttgttccctgatccttcacagatcaaggtgatgcctacctctttggagctgctgcctctagctctccacggctgcatgctcctctgcgtggcccagccttcacagcgctccagaagaagctgatgccctgaggctgggcacagtggaaatcataataaagcgattgcgatgctcaaaaagct

SEQ ID NO: 72088 - DNA, 3177 bp, Homo sapiens
  misc_feature (33)..(34): n is a, c, g, or t
  misc_feature (36)..(36): n is a, c, g, or t
cagaaaacggcgcatagggtaggctgggcagcnnanagattatgtgaaggttcgttgggaccctccggagccagtggggtactgcaaagagccatgggggtgttgatgtccaagcggcagacagtggagcaggtgcagaaggtgagtctggctgtgtctgctttcaaggatgggctgcgggacaggccttccatccgacgcacaggtgagctgccagggtcccgccgtggcactgtagagggctccgtccaggaggtacaggaggagaaggaagcagaagcaggaacctcggtggtccaggaagagagtagtgccggccgcgcagcctgggagcggctccgagatgggcgcggcgtggagcctgaggagtttgacaggacaagtcgattcacaccccctgcgttcatccgccccacccggaagctggatgatgacaaacctccagaaatctgcctggagcccagagagcctgttgtcaacgatgagatgtgtgatgtttgtgaggtctggacagctgagagcctcttcccgtgcagggtctgcaccagggttttccatgatggctgcctgcgccgcatgggctacatccaaggagacagtgcagcggaggtgacggagatggcccacacagaaacaggctggagctgccactactgtgacaacatcaacttgctgcttactgaggaggaaatgtatagcctcacggagacctttcagcggtgtaaagtcatccctgattgctccctgacactggaggactttctgcgttaccgccaccaagcagccaagcggggggaccgtgacagggccctgagtgaggagcaagaagagcaggcggcccgccagtttgctgccctggaccctgaacatcgaggccacatagagtggcctgacttcttgtcccatgagtccctcctgcttctgcagcagttgcgtccccagaactctctgttgaggcttctgacagtgaaggagcgggagcgagcccgagccgccttcctggctcggggcagtgggagcaccgtcagtgaggcagagtgccgccgggcccagcactcttggttttgcaaacggttcccagaggctccttcctgcagtgtcagcatcagccatgtgggtcccatcgcagatagcagcccagccagcagcagcagcaagagtcaggacaagaccctgctgcccacagagcaggagtccagatttgtggactggcctaccttcctgcaagagaatgtcctctacatcctggctgctcgccccaacagcgcagccattcacctgaagcccccaggatagcatggagcagagaagctcggtttgaggacagtgacatcctctccctcctttcctttctcccttcccccaccaacctctggcacagagactcatggggttgggacactgccagcgtcttaacttgtcactaagctttaaggcactgaaatcaccattcccctcacaatagaggcagtgaatgcattgccacaaggagaagccctgggagctgtggcagcatcctctcctggaccgcccctgccccacatcatagacgggacctgccaccacacttatatacatgtgcacatgctgcccagctgtccatgccttcagaagcctggttctttttggttgagaaaggaccaaagtccctttgtgaagcccctggtatagaggagggggtctctactcaccccttctataggcaggccagttctaatttccaatagataagtctctggccaagtgattcttaggaagggggcatgtcagactcgcatgcctgcctagagctcctggagatcctaatgggccccgctttctccaccaaaaatcccttctgcagtcagctgctgttactagtaggtgtgcattatgtacctcggctgtactgagttgggaaaagagttaaacatcaccactgaaattcagccctttatttatttaaattccaattcctggtgacagaaaaggcaactagcctggagaatcctgactggaagagggggaggcagcccttcccagggactcgggattctaggaacctctcagtcaggtcacctgagtccaaaagtctttagcagggtagtcaaaaatcaaggtgagccttcttggccccatttttcagatggtagctcatggcctagggccaagggggcctgaatggagcaaacacactggcaggagccacagccctctgtgttagatgcttcacccaagtcaccgaccacagagactgacgagagcacactctggaggaagaggagagaacggggctctgcttcctcatcattccagctcaactcaactgtagacaccttccacagcccaagaaagatctgcagagccctgagcagggactctttcagccatcctgacaaacaggataagaggctggggcttaagaagaggctctgcagagaaggtcctgggaaagccttacagaagttttccgcttctccctatcactgagactcggcttgagtggctgcttctcctcactgctcatcacatgtccttccccagcaggctagggcttgggcctggcatggaaggccttttggggcaatcagaggctgccacaagagcaccaagcctggcctccaagccccagccctccttcctaagtactcatcaaattcaaattcttcagtccgtgtgttatggctcatcttggccggccgtggggtccatgttctaggcttctgtttccaacttaatgacttaggcatagcgagatctgactaccaagagttattcaaaagggagtggagtgcagtcatgcagaagcaaacacgtcttcattgctcgaggcccttgtgctaaatcgggtgcgtacagaagaacacacaccgctcggtgctgaatgtttcgaggaaagcaaggagctgcggccaggggcttcttgagagccctgtgtagtctcctcctgtaggaaccaccttagctggaagcagggtggtgagctgctggggttggattatttgggactgaaatgaagcagacagaaggtaacttgacagcaagctgaggggaacgtccccaagccctgtctccctgtctctacagctgcatgctcctctgcgtggcccagccttcacagcgctccagaagaagctgatgccctgaggctgggcacagtggaaatcataataaagcgattgcgatgctcaaaaagct

SEQ ID NO: 72089 - DNA, 1491 bp, Homo sapiens
  misc_feature (33)..(34): n is a, c, g, or t
  misc_feature (36)..(36): n is a, c, g, or t
cagaaaacggcgcatagggtaggctgggcagcnnanagattatgtgaaggttcgttgggaccctccggagccagtggggtactgcaaagagccatgggggtgttgatgtccaagcggcagacagtggagcaggtgcagaaggtgagtctggctgtgtctgctttcaaggatgggctgcgggacaggccttccatccgacgcacaggtgagctgccagggtcccgccgtggcactgtagagggctccgtccaggaggtacaggaggagaaggaagcagaagcaggaacctcggtggtccaggaagagagtagtgccggccgcgcagcctgggagcggctccgagatgggcgcggcgtggagcctgaggagtttgacaggacaagtcgattcacaccccctgcgttcatccgccccacccggaagctggatgatgacaaacctccagaaatctgcctggagcccagagagcctgttgtcaacgatgagatgtgtgatgtttgtgaggtctggacagctgagagcctcttcccgtgcagggtctgcaccagggttttccatgatggctgcctgcgccgcatgggctacatccaaggagacagtgcagcggaggtgacggagatggcccacacagaaacaggctggagctgccactactgtgacaacatcaacttgctgcttactgaggaggaaatgtatagcctcacggagacctttcagcggtgtaaagtcatccctgattgctccctgacactggaggactttctgcgttaccgccaccaagcagccaagcggggggaccgtgacagggccctgagtgaggagcaagaagagcaggcggcccgccagtttgctgccctggaccctgaacatcgaggccacatagagtggcctgacttcttgtcccatgagtccctcctgcttctgcagcagttgcgtccccagaactctctgttgaggcttctgacagtgaaggagcgggagcgagcccgagccgccttcctggctcggggcagtgggagcaccgtcagtgaggcagagtgccgccgggcccagcactcttggttttgcaaacggttcccagaggctccttcctgcagtgtcagcatcagccatgtgggtcccatcgcagatagcagcccagccagcagcagcagcaagagtcaggacaagaccctgctgcccacagagcaggagtccagatttgtggactggcctaccttcctgcaagagaatgtcctctacatcctggctgctcgccccaacagcgcagccattcacctgaagcccccaggatagcatggagcagagaagctcggtttgaggacagtgacatcctctccctcctttcctttctcccttcccccaccaacctctggcacagagactcatggggttgggacactgccagcgtcttaacttgtcactaagctttaacgtcgtctagatcatcactactccctcacgttagagctgccgacgtaggggatcctc

SEQ ID NO: 72090 - DNA, 1371 bp, Homo sapiens
  misc_feature (33)..(34): n is a, c, g, or t
  misc_feature (36)..(36): n is a, c, g, or t
cagaaaacggcgcatagggtaggctgggcagcnnanagattatgtgaaggttcgttgggaccctccggagccagtggggtactgcaaagagccatgggggtgttgatgtccaagcggcagacagtggagcaggtgcagaaggtgagtctggctgtgtctgctttcaaggatgggctgcgggacaggccttccatccgacgcacaggtgagctgccagggtcccgccgtggcactgtagagggctccgtccaggaggtacaggaggagaaggaagcagaagcaggaacctcggtggtccaggaagagagtagtgccggccgcgcagcctgggagcggctccgagatgggcgcggcgtggagcctgaggagtttgacaggacaagtcgattcacaccccctgcgttcatccgccccacccggaagctggatgatgacaaacctccagaaatctgcctggagcccagagagcctgttgtcaacgatgagatgtgtgatgtttgtgaggtctggacagctgagagcctcttcccgtgcagggtctgcaccagggttttccatgatggctgcctgcgccgcatgggctacatccaaggagacagtgcagcggaggtgacggagatggcccacacagaaacaggctggagctgccactactgtgacaacatcaacttgctgcttactgaggaggaaatgtatagcctcacggagacctttcagcggtgtaaagtcatccctgattgctccctgacactggaggactttctgcgttaccgccaccaagcagccaagcggggggaccgtgacagggccctgagtgaggagcaagaagagcaggcggcccgccagtttgctgccctggaccctgaacatcgaggccacatagagtggcctgacttcttgtcccatgagtccctcctgcttctgcagcagttgcgtccccagaactctctgttgaggcttctgacagtgaaggagcgggagcgagcccgagccgccttcctggctcggggcagtgggagcaccgtcagtgaggcagagtgccgccgggcccagcactcttggttttgcaaacggttcccagaggctccttcctgcagtgtcagcatcagccatgtgggtcccatcgcagatagcagcccagccagcagcagcagcaagagtcaggacaagaccctgctgcccacagagcaggagtccagaaggtaacttgacagcaagctgaggggaacgtccccaagccctgtctccctgtctctacagctgcatgctcctctgcgtggcccagccttcacagcgctccagaagaagctgatgccctgaggctgggcacagtggaaatcataataaagcgattgcgatgctcaaaaagct

SEQ ID NO: 72091 - DNA, 5559 bp, Homo sapiens
  misc_feature (33)..(34): n is a, c, g, or t
  misc_feature (36)..(36): n is a, c, g, or t
cagaaaacggcgcatagggtaggctgggcagcnnanagattatgtgaaggttcgttgggaccctccggagccagtggggtactgcaaagagccatgggggtgttgatgtccaagcggcagacagtggagcaggtgcagaaggtgagtctggctgtgtctgctttcaaggatgggctgcgggacaggccttccatccgacgcacaggtgagctgccagggtcccgccgtggcactgtagagggctccgtccaggaggtacaggaggagaaggaagcagaagcaggaacctcggtggtccaggaagagagtagtgccggccgcgcagcctgggagcggctccgagatgggcgcggcgtggagcctgaggagtttgacaggacaagtcgattcacaccccctgcgttcatccgccccacccggaagctggatgatgacaaacctccagaaatctgcctggagcccagagagcctgttgtcaacgatgagatgtgtgatgtttgtgaggtctggacagctgagagcctcttcccgtgcagggtctgcaccagggttttccatgatggctgcctgcgccgcatgggctacatccaaggagacagtgcagcggaggtgacggagatggcccacacagaaacaggctggagctgccactactgtgacaacatcaacttgctgcttactgaggaggaaatgtatagcctcacggagacctttcagcggtgtaaagtcatccctgattgctccctgacactggaggactttctgcgttaccgccaccaagcagccaagcggggggaccgtgacagggccctgagtgaggagcaagaagagcaggcggcccgccagtttgctgccctggaccctgaacatcgaggccacatagagtggcctgacttcttgtcccatgagtccctcctgcttctgcagcagttgcgtccccagaactctctgttgaggcttctgacagtgaaggagcgggagcgagcccgagccgccttcctggctcggggcagtgggagcaccgtcagtgaggcagagtgccgccgggcccagcactcttggttttgcaaacggttcccagaggctccttcctgcagtgtcagcatcagccatgtgggtcccatcgcagatagcagcccagccagcagcagcagcaagagtcaggacaagaccctgctgcccacagagcaggagtccagatttgtggactggcctaccttcctgcaagagaatgtcctctacatcctggctgctcgccccaacagcgcagccattcacctgaagcccccaggatagcatggagcagagaagctcggtttgaggacagtgacatcctctccctcctttcctttctcccttcccccaccaacctctggcacagagactcatggggttgggacactgccagcgtcttaacttgtcactaagctttaaggcactgaaatcaccattcccctcacaatagaggcagtgaatgcattgccacaaggagaagccctgggagctgtggcagcatcctctcctggaccgcccctgccccacatcatagacgggacctgccaccacacttatatacatgtgcacatgctgcccagctgtccatgccttcagaagcctggttctttttggttgagaaaggaccaaagtccctttgtgaagcccctggtatagaggagggggtctctactcaccccttctataggcaggccagttctaatttccaatagataagtctctggccaagtgattcttaggaagggggcatgtcagactcgcatgcctgcctagagctcctggagatcctaatgggccccgctttctccaccaaaaatcccttctgcagtcagctgctgttactagtaggtgtgcattatgtacctcggctgtactgagttgggaaaagagttaaacatcaccactgaaattcagccctttatttatttaaattccaattcctggtgacagaaaaggcaactagcctggagaatcctgactggaagagggggaggcagcccttcccagggactcgggattctaggaacctctcagtcaggtcacctgagtccaaaagtctttagcagggtagtcaaaaatcaaggtgagccttcttggccccatttttcagatggtagctcatggcctagggccaagggggcctgaatggagcaaacacactggcaggagccacagccctctgtgttagatgcttcacccaagtcaccgaccacagagactgacgagagcacactctggaggaagaggagagaacggggctctgcttcctcatcattccagctcaactcaactgtagacaccttccacagcccaagaaagatctgcagagccctgagcagggactctttcagccatcctgacaaacaggataagaggctggggcttaagaagaggctctgcagagaaggtcctgggaaagccttacagaagttttccgcttctccctatcactgagactcggcttgagtggctgcttctcctcactgctcatcacatgtccttccccagcaggctagggcttgggcctggcatggaaggccttttggggcaatcagaggctgccacaagagcaccaagcctggcctccaagccccagccctccttcctaagtactcatcaaattcaaattcttcagtccgtgtgttatggctcatcttggccggccgtggggtccatgttctaggcttctgtttccaacttaatgacttaggcatagcgagatctgactaccaagagttattcaaaagggagtggagtgcagtcatgcagaagcaaacacgtcttcattgctcgaggcccttgtgctaaatcgggtgcgtacagaagaacacacaccgctcggtgctgaatgtttcgaggaaagcaaggagctgcggccaggggcttcttgagagccctgtgtagtctcctcctgtaggaaccaccttagctggaagcagggtggtgagctgctggggttggattatttgggactgaaatgaagcagacaggagacaaatctgggctcaggtgtatggcccacagcttttagaaatgctcttcagccgtcccccaggattgatccataggaggggccattattcagtctagtcaaaacaagaaagcgcaggactcctgggcctaagaactgcatctgaagcagccaggcctggggttttgcactgagatgaaagcacattaagcacaggggctcttacctactctcctggcaaatcatctcctgtgccactggccttgggctgctcgatctcacagacggggcattttgagtagagacaagctctgggctttgagagctgaatagcatttttctcctgcctcatcagtcacagggactggaagtccatcttgttccctgatccttcacagatcaaggtgatgcctacctctttggagctgctgcctctagctctccacgggtgagtgaggagagttggtgggccaggtcaggcctgccgtattccagggcctggcaaagcagccccagagttcttccacaacaggaacaggcccatttggatcacgcttctccctattccagaacagcaaacttcctgggtgagggcctgctacagagatcccaggggacacttccctcagcaaagagtagagttcccatcccacaagagtcctaggaagcaggaaagcacgaaggagcagccagcctcttctccacaggcagtcatctagctttttaccaaaggggaagtgccgttgctccccaagtccagagttgcagacgccctgccccaacccccgtccagaatctccctttgcagtgttctaatccccagagcccctctgcggtatgtatagagttgttaaaaacgttcagaaacccagtgaagcccatttcgttttcaagccctcccatcactgtgactctgaaattctgccaagtacaaatattagcgtttggctctaataagggtatgagaaaatgtttcagtcttttctttgtggctacccaaaattgagatcagtgtttctaaccaaggaaggcctgggttatagacaggctcctctgaagcccacttgccctaagcatttttcacctagcattcctcttcctcatgttcagatgtgaatgaaggggcagctggaggatgtggtggagctgcagggaccgagggtcagctgagcagtggccctggccacaaaaccactccaagtctgctccttggcttcctctcctgagcccagccttccccaacagaacacttgagcaagggcccctagagtatcccagggatggagcagtcccctcactctaggtactgatctaaccttcaagtgctcctcttcatttgaggacacctacagtagaaaccatgaggacattgcctctttctgccctcagcccaagtacctggggctagcagggcagataccagcctttctggtcctgctgctccctatgggatgtcaccctgaccttgcttaagtggccaagtcttagggtccccttattcctgtcaccattatgaaaaacacagcattaaactgcctgggaagaggacacctccttgggggagtgagccccaaggttatacccaggactcatagcccaaagcacaacctcggccattgcaggtttcacagcttcagtcagagtggtgccaggaagcccaaaagccaagagggaaggtcagcagaagctgcctggcaaggccccaggccagccaggcccaccccagagccaagagaaacttcaagcaggactgagaactggtagctggctctagtgatcctgaaagcatgttcccttcagaccagcagagtgaagacagacagatgtgtggccctaaaaggcagaacagttttgatgccagaacttcaggactgtcaccacagtccctttttacccctcctctatttacagtgaaataaaattcctattttcaaaaaaaaaaaaaagaaaaaaaaaaaaaaagaaaaataacaaaaaaaaaggggggggggggccaaaataggaagaatccgcaccgaggggagggacacaggaagtaaacggcagacacacaagaattgttatttgagctaggaaaccaagaagagtgggccaccaatagaggtgagcgtaaatataaagaacaaaacggcgaacggaaggcggcaggcgaatacaacagagcgcggagacaagggggagaaacacgcggacacaacgtgggggcaaccaactcggaggaagaaagagacgagacacaactaacgaacagcagggggggggagggaggcacaaccacaataagtgtgggagggaaaaaagaaattactcttaaacaagaaagaaatattatacaaaagaagaagtacataaaaagagggggagaaagtaatttaaaagacaagatattatctaagagtgggagttagtacaaatacgggtgggtgtgaacgcaaaagcacagatgaggatgaaaaataatagagaagtaaagaggaaaagagtaagaaaaaaaagttataggtagataaacgaagaaggagggaatattgttaactaagagtacgaacagatatctatatttacttaacgag

SEQ ID NO: 72092 - DNA, 397 bp, Homo sapiens
tgaaagtgaatctgctccaggaagccttttctgttctgactgttcaggtctgggtccttattccttcctgtgccttcttttggttcacttttcagatagagactataagatggttaaaaacaaaccatatgttgaccaccaaccaggcatgggcacagactgagcatccttaaagacattattccactagagtctcataagagttcattgagggacgtattattatccctactttataaatgatgaaattcggagtcatgacccttcataacttgatccataggcaagcaggcagtaaatgcagatgactaacaatatgcagattcaaatccaggtctgctaatataaaacccacagtcttacccagttcaccgaagtgtaaatttaaagataagtg

SEQ ID NO: 72093 - DNA, 2652 bp, Homo sapiens
tgattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtagctacatgaatgtgtaagatcttggaggaagacagcagagagagagagagagatcagagatcccagggttaaaagttggagaaatttcacagtacatcatccaaaagaggagtccatgatggaggcagaggtaaacttggagaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaata

SEQ ID NO: 72094 - DNA, 2430 bp, Homo sapiens
ccagcccgggagcgcgccacatgcagatcctgggatggccgccaggggccgccgggctctttgttttcctttctcacccgggtcggggccagaggcctgcagagcgcatgctctggggcagttcgcggcccggcggggagcgccggagttccttgtggccgacgtgcaccaaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaata

SEQ ID NO: 72095 - DNA, 787 bp, Homo sapiens
  misc_feature (713)..(713): n is a, c, g, or t
  misc_feature (716)..(716): n is a, c, g, or t
  misc_feature (726)..(726): n is a, c, g, or t
gggctaggtagcggaggctgggttgcggacgtgcaccaaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaangantctggtcccnatgtgtgttgtctaattccggaaaccggggccctgaaatccggagcctgggggccatactt

SEQ ID NO: 72096 - DNA, 730 bp, Homo sapiens
agggaacagccttcagctcatgcctagggatttcctggtcctgctgtaactacatagatctcacctgagtaaagtgatttttttctgaaccagtggttctagtatgttttcaatccatattctcaggtgggtttgggtaactgcagtgctgggcaggaaatgaatgaatttctattgacttgcaaggtagaggtgaagcaaagctgtcagtaggtgttcaggtcccactctgctaaacttcagcttgcaatacccctttcttagactttccaaacaggcacttctggccttgttctttgtgtaggcagacagtattggttgcctatcttaggagtactagactgggtttgaatcctgatcccaccacttgctgttcatgagactttgggtgagttactcagcccctctgcctcaatttcatgttcacaaaataagtgataaactacctcatagagttgtaataaggacaaaggagttggtatttgtgaaaagattcttagggtctctagatggagtgcagcagcatgatcacttattaaataacattcttttgtgacttctcaggaaccaaggatacagtatccaattttttgttttttgtttttttttttttttgagagggagtctcgctctgtcgcccaggctggagtgcagtggcacaatctcagctcactgcaagctcagcctccccagcagctgggactacaggtgcacgccgccacacccggct

SEQ ID NO: 72097 - DNA, 379 bp, Homo sapiens
ctccctttcacgtgaataatgtgctcagttcttaatctccacaaaaatcctgtgagagaggtcatttgtgtccccatttcacagatgacaaaacttagaaagttcatactaacagtctgtggcagagcaggggcttctgcacaggttgtctgatcccagagcctgtgacctctcctcgctgtcgtcatcctctacactcagggtctatcttcttcacccttcagtctcacacaggtcccacagcacagaacccggcttggtgggtctggcaaggagattgtgtgggaagagaagggaggatgtgatagataggaaatgtagcttcagaatcaggcagataggcctggcttgcttttctacgctgccctttacctgctgt

SEQ ID NO: 72098 - DNA, 3851 bp, Homo sapiens
tgattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaagctacatgaatgtgtaagatcttggaggaagacagcagagagagagagagagatcagagatcccagggttaaaagttggagaaatttcacagtacatcatccaaaagaggagtccatgatggaggcagaggtaaacttggagaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaata

SEQ ID NO: 72099 - DNA, 4325 bp, Homo sapiens
  misc_feature (4315)..(4315): n is a, c, g, or t
tgattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaagctacatgaatgtgtaagatcttggaggaagacagcagagagagagagagagatcagagatcccagggttaaaagttggagaaatttcacagtacatcatccaaaagaggagtccatgatggaggcagaggtaaacttggagaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaataggccacttgttttctacacattccctgctttttaagggagcacatattatgtgccaggcactgctgggaaagacagaataaactataaacctggtgttgaggctacaacttaagtgatgtcaagatgtcctgaggtgccaaccagctgtcagtgtgactgtaacaaaggcttcaaatctgtcaagaagtaaggaaaagttttgtttgagttttgtttgggtatttctgttttgggagtcactggattatttttaaatgctgcatagtacaatagaggcagggtggatcttttaataccaaaccaaaaaaaaaaaaaaaaaaagaaattggtcgggcgtggtgccgggtgcctgtggtcccagctgctcgggaggctggggcgggagagtggcgtgaacccgggaggtggagcttgcagtgggccgagatcgcaccactctactccagtctgggcgacagagcgnactctgtctc

SEQ ID NO: 72100 - DNA, 3752 bp, Homo sapiens
tgattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaagctacatgaatgtgtaagatcttggaggaagacagcagagagagagagagagatcagagatcccagggttaaaagttggagaaatttcacagtacatcatccaaaagaggagtccatgatggaggcagaggtaaacttggagaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaata

SEQ ID NO: 72101 - DNA, 3745 bp, Homo sapiens
gcttttggagacagattcgcagggtcgcttcttctcctggattgttaaggattccaagtaactcttattggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaagctacatgaatgtgtaagatcttggaggaagacagcagagagagagagagagatcagagatcccagggttaaaagttggagaaatttcacagtacatcatccaaaagaggagtccatgatggaggcagaggtaaacttggagaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaata

SEQ ID NO: 72102 - DNA, 3944 bp, Homo sapiens
tgattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaagctacatgaatgtgtaagatcttggaggaagacagcagagagagagagagagatcagagatcccagggttaaaagttggagaaatttcacagtacatcatccaaaagaggagtccatgatggaggcagaggtaaacttggagaggacaggaagatgtcacccaagcgcatagctaaaagaaggtcccccccagcagatgccatccccaaaagcaagaaggtgaaggacacgagggccgctgcctcccgccgcgttcctggcgcccgctcctgccaaggtgcctgcgggccgagccctcctgaccagaaaacccgaccagtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaata

SEQ ID NO: 72103 - DNA, 3902 bp, Homo sapiens
tgattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaagctacatgaatgtgtaagatcttggaggaagacagcagagagagagagagagatcagagatcccagggttaaaagttggagaaatttcacagtacatcatccaaaagaggagtccatgatggaggcagaggtaaacttggagaggacaggaagatgtcacccaagcgcatagctaaaagaaggtcccccccagcagatgccatccccaaaagcaagaaggtgaaggacacgagggccgctgcctcccgccgcgttcctggcgcccgctcctgccaagtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaata

SEQ ID NO: 72104 - DNA, 3848 bp, Homo sapiens
ccagaagtgtattttccctcatttaagtggacctttcaaacaataatattttaaaattatatctgataggcccactcctaatccacccagtgctaattcccccaaccttcctgtaagtcagttaactcacgtccccccaatattatattaccccatttctcatcagacctactgtgattaaaaaaccgaaataatggagaaagccacatctggcacctgtcaatttttatggaagttgtttatataaattttaaatggcttaaaatcaccagatgcgaatttttcactatgatactttataacttgtactttctttgttctttctgtctttttttgagatggagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaagctacatgaatgtgtaagatcttggaggaagacagcagagagagagagagagatcagagatcccagggttaaaagttggagaaatttcacagtacatcatccaaaagaggagtccatgatggaggcagaggtaaacttggagaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaata

SEQ ID NO: 72105 - DNA, 3935 bp, Homo sapiens
tgattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaagctacatgaatgtgtaagatcttggaggaagacagcagagagagagagagagatcagagatcccagggttaaaagttggagaaatttcacagtacatcatccaaaagaggagtccatgatggaggcagaggtaaacttggagaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccggcactgcctcttccacacttcccagaggcttggatggggcaaggaggtgtggaggcagggattgtcgcatctcagagtttccaaggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaata

SEQ ID NO: 72106 - DNA, 3695 bp, Homo sapiens
tgattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaagctacatgaatgtgtaagatcttggaggaagacagcagagagagagagagagatcagagatcccagggttaaaagttggagaaatttcacagtacatcatccaaaagaggagtccatgatggaggcagaggtaaacttggagaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaata

SEQ ID NO: 72107 - DNA, 3798 bp, Homo sapiens
tgattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatatttcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaagctacatgaatgtgtaagatcttggaggaagacagcagagagagagagagagatcagagatcccagggttaaaagttggagaaatttcacagtacatcatccaaaagaggagtccatgatggaggcagaggtaaacttggagaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaata

SEQ ID NO: 72108 - DNA, 3898 bp, Homo sapiens
tgattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaagctacatgaatgtgtaagatcttggaggaagacagcagagagagagagagagatcagagatcccagggttaaaagttggagaaatttcacagtacatcatccaaaagaggagtccatgatggaggcagaggtaaacttggagaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcggttgctgtgaagttaaatgagttaatgagaagaatatcaggcagatgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaata

SEQ ID NO: 72109 - DNA, 2261 bp, Homo sapiens
tgattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaaggtaaagttacctactggcataggggaggtgggacagccgttaagccatttggaacttgatggagacaggtttgagggaggtgggtgagattggagtttggtggactgtagagcttgcttgccaaggtgttgaggtcagggttggtttgagaatggaagctagttactagctatgattgtgggggaacacagcttgatttttcttacaagctaagaggagtgaggcagtgtttaagagggcatgttaaatgcagccaggcttggtggctcacacccgtaatcccagcacttaggctaaggcaggcggatcacaacatctagagatcctggccaacgcggtgaaaccctgtctgtactaaaaatacaaaataactgggcatggtggtgtgcacctgtgggaggctgaggcagaattgctggaacccgggagatggaggttgtactgagctgagaccttgccactgcgctccagcctggtgacagagttaagtctcaaaaaaaaaggcatcttcctaaagcaattgtatttgtgcttacctgtgccaggcactgttctaggtaagcactaagtgggctttaatacagcatattccaatggggaatcccaggaaccaaaagactaattgtccaagtccacaactagaagtggcacctctgcagaaacaagcatcaaattccctgctcaggaagaagccagatgagtcagccccattcgtctgtatgcccagtcccatccgtgtcctgctgtaactacatagatctcacctgagtaaagtgatttttttctgaaaaaaaagagagcaagaaaaaa

SEQ ID NO: 72110 - DNA, 3183 bp, Homo sapiens
tgattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaagctacatgaatgtgtaagatcttggaggaagacagcagagagagagagagagatcagagatcccagggttaaaagttggagaaatttcacagtacatcatccaaaagaggagtccatgatggaggcagaggtaaacttggagaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccctccccaactcagatccggcccggtccccgtccccttccctc

SEQ ID NO: 72111 - DNA, 2881 bp, Homo sapiens
tgattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaaggtaaagttacctactggcataggggaggtgggacagccgttaagccatttggaacttgatggagacaggtttgagggaggtgggtgagattggagtttggtggactgtagagcttgcttgccaaggtgttgaggtcagggttggtttgagaatggaagctagttactagctatgattgtgggggaacacagcttgatttttcttacaagctaagaggagtgaggcagtgtttaagagggcatgttaaatgcagccaggcttggtggctcacacccgtaatcccagcacttaggctaaggcaggcggatcacaacatctagagatcctggccaacgcggtgaaaccctgtctgtactaaaaatacaaaataactgggcatggtggtgtgcacctgtgggaggctgaggcagaattgctggaacccgggagatggaggttgtactgagctgagaccttgccactgcgctccagcctggtgacagagttaagtctcaaaaaaaaaggcatcttcctaaagcaattgtatttgtgcttacctgtgccaggcactgttctaggtaagcactaagtgggctttaatacagcatattccaatggggaatcccaggaaccaaaagactaattgtccaagtccacaactagaagtggcacctctgcagaaacaagcatcaaattccctgctcaggaagaagccagatgagtcagccccattcgtctgtatgcccagtcccatccgtgtcctgctgtaactacatagatctcacctgagtaaagtgatttttttctgaaccagtggttctagtatgttttcaatccatattctcaggtgggtttgggtaactgcagtgctgggcaggaaatgaatgaatttctattgacttgcaaggtagaggtgaagcaaagctgtcagtaggtgttcaggtcccactctgctaaacttcagcttgcaatacccctttcttagactttccaaacaggcacttctggccttgttctttgtgtaggcagacagtattggttgcctatcttaggagtactagactgggtttgaatcctgatcccaccacttgctgttcatgagactttgggtgagttactcagcccctctgcctcaatttcatgttcacaaaataagtgataaactacctcatagagttgtaataaggacaaaggagttggtatttgtgaaaagattcttagggtctctagatggagtgcagcagcatgatcacttattaaataacattcttttgtgacttctcaggaaccaaggatacagtatccaattttttgttttttgtttttttttttttttgagagggagtctcgctctgtcgcccaggctggagtgcagtggcacaatctcagctcactgcaagctcagcctccccagcagctgggactacaggtgcacgccgccacacccggct

SEQ ID NO: 72112 - DNA, 2483 bp, Homo sapiens
tgattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaagctacatgaatgtgtaagatcttggaggaagacagcagagagagagagagagatcagagatcccagggttaaaagttggagaaatttcacagtacatcatccaaaagaggagtccatgatggaggcagaggtaaacttggagaggacaggaagatgtcacccaagcgcatagctaaaagaaggtcccccccagcagatgccatccccaaaagcaagaaggtgaaggacacgagggccgctgcctcccgccgcgttcctggcgcccgctcctgccaagtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgtcgaacgactcctggtcccaagtgtgtgatgcgaaatcagggaagccgggccactaaccagagcctcggggcactaccttgcaccagaggcaagaggatgcctcaaacacccgtgacgggacatctacccaacaaccaccgcgggcctcgcccccacgtccaccaccg

SEQ ID NO: 72113 - DNA, 1932 bp, Homo sapiens
tgattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaaggtaaagttacctactggcataggggaggtgggacagccgttaagccatttggaacttgatggagacaggtttgagggaggtgggtgagattggagtttggtggactgtagagcttgcttgccaaggtgttgaggtcagggttggtttgagaatggaagctagttactagctatgattgtgggggaacacagcttgatttttcttacaagctaagaggagtgaggcagtgtttaagagggcatgttaaatgcagccaggcttggtggctcacacccgtaatcccagcacttaggctaaggcaggcggatcacaacatctagagatcctggccaacgcggtgaaaccctgtctgtactaaaaatacaaaataactgggcatggtggtgtgcacacacatgcctgtaatcccagctactccagaggtggaggttgcagtgagcccatatcgcgccattgcactccatcctgggcaatcaagctt

SEQ ID NO: 72114 - DNA, 2312 bp, Homo sapiens
caggcccgtgtcattagcgaactatgcccttgaacccaggcgacggacgctactggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaata

SEQ ID NO: 72115 - DNA, 2523 bp, Homo sapiens
ccagcccgggagcgcgccacatgcagatcctgggatggccgccaggggccgccgggctctttgttttcctttctcacccgggtcggggccagaggcctgcagagcgcatgctctggggcagttcgcggcccggcggggagcgccggagttccttgtggccgacgtgcaccaaggacaggaagatgtcacccaagcgcatagctaaaagaaggtcccccccagcagatgccatccccaaaagcaagaaggtgaaggacacgagggccgctgcctcccgccgcgttcctggcgcccgctcctgccaaggtgcctgcgggccgagccctcctgaccagaaaacccgaccagtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaata

SEQ ID NO: 72116 - DNA, 2034 bp, Homo sapiens
  misc_feature (24)..(24): n is a, c, g, or t
  misc_feature (31)..(31): n is a, c, g, or t
aactttaggctagtacgaggccgngtggtgnctagcaaaagtggcaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaata

SEQ ID NO: 72117 - DNA, 1808 bp, Homo sapiens
tgattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactggccaagaaaaaaaaaaaaaaaaaaaaaaaaaaacctgttgtgtggggcgcccctcgggccccgcgagaaaagacttttttacccacttccgttgtggggcgcgcgcgcggccccacaaaggtgtaacggggaaacgtgggcccaaagccgttttcccgagaggaaacccggggccaggaacacggcggcggcggggttctttccaccctaatgataaaaaaaagcgcgccgcggggggggcacccaggagcgggttctgagaaccaacctccaaagaggagagtccacggcggagccaatagcagggggagcctcataacacacacggggagtcccaagcaggagacataagaatgctaaaatatagccccccgagcggggtggagaattccaccaagcacagcaacactcaaacacaagcagcaacacaacaagacaacagaccgagacagagaagaaaaaagaacagcacacgacaacgaccaaaggggaaggacagcagccaacgaaacagaagaaaagacgctagagaacagaaagacagcaaaagagcaagatagaagagcacagcagaaaaaaacgagcacaagcaagaagcggagaacagagagcagacaggagagagacaagaggacgaagaagcacgaaaaggaggaagaagaggcaagagcagaagacagagagcgcaagaggagaacgacagaaaaagagagaggaacgaaaaagagaagcagagaaagaagaagaacaacgaacaacgcacagaaaagacgcaaacgaaggaagaagagaagcacggcaagacggaccggtaacaacgagaacactc

SEQ ID NO: 72118 - DNA, 1182 bp, Homo sapiens
  misc_feature (35)..(35): n is a, c, g, or t
  misc_feature (54)..(54): n is a, c, g, or t
  misc_feature (63)..(63): n is a, c, g, or t
tcatcctgccctgtgcccagctggtagttggtgcncatgccccaggcgaaaacncgaccatcnttggtcacagcataccccacagaggccccacaagccaccgaggagacagcagcagcctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaata

SEQ ID NO: 72119 - DNA, 775 bp, Homo sapiens
tgattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctgggaggcggaagttgcagtgagcaag

SEQ ID NO: 72120 - DNA, 1429 bp, Homo sapiens
tgattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttgctgtgggaggctgaggcagaattgctggaacccgggagatggaggttgtactgagctgagaccttgccactgcgctccagcctggtgacagagttaagtctcaaaaaaaaaggcatcttcctaaagcaattgtatttgtgcttacctgtgccaggcactgttctaggtaagcactaagtgggctttaatacagcatattccaatggggaatcccaggaaccaaaagactaattgtccaagtccacaactagaagtggcacctctgcagaaacaagcatcaaattccctgctcaggaagaagccagatgagtcagccccattcgtctgtatgcccagtcccatccgtgtcctgctgtaactacatagatctcacctgagtaaagtgatttttttctgaaccagtggttctagtatgttttcaatccatattctcaggtgggtttgggtaactgcagtgctgggcaggaaatgaatgaatttctattgacttgcaaggtagaggtgaagcaaagctgtcagtaggtgttcaggtcccactctgctaaacttcagcttgcaatacccctttcttagactttccaaacaggcacttctggccttgttctttgtgtaggcagacagtattggttgcctatcttaggagtactagactgggtttgaatcctgatcccaccacttgctgttcatgagactttgggtgagttactcagcccctctgcctcaatttcatgttcacaaaataagtgataaactacctcatagagttgtaataaggacaaaggagttggtatttgtgaaaagattcttagggtctctagatggagtgcagcagcatgatcacttattaaataacattcttttgtgacttctcaggaaccaaggatacagtatccaattttttgttttttgtttttttttttttttgagagggagtctcgctctgtcgcccaggctggagtgcagtggcacaatctcagctcactgcaagctcagcctccccagcagctgggactacaggtgcacgccgccacacccggct

SEQ ID NO: 72121 - DNA, 1005 bp, Homo sapiens
aattcggcacgaggtttttttttgagacttaactctgtcaccaggctggagcgcagtggcaaggtctcaaaaaaaaaggcatcttcctaaagcaattgtatttgtgcttacctgtgccaggcactgttctaggtaagcactaagtgggctttaatacagcatattccaatggggaatcccaggaaccaaaagactaattgtccaagtccacaactagaagtggcacctctgcagaaacaagcatcaaattccctgctcaggaagaagccagatgagtcagccccattcgtctgtatgcccagtcccatccgtgtcctgctgtaactacatagatctcacctgagtaaagtgatttttttctgaaccagtggttctagtatgttttcaatccatattctcaggtgggtttgggtaactgcagtgctgggcaggaaatgaatgaatttctattgacttgcaaggtagaggtgaagcaaagctgtcagtaggtgttcaggtcccactctgctaaacttcagcttgcaatacccctttcttagactttccaaacaggcacttctggccttgttctttgtgtaggcagacagtattggttgcctatcttaggagtactagactgggtttgaatcctgatcccaccacttgctgttcatgagactttgggtgagttactcagcccctctgcctcaatttcatgttcacaaaataagtgataaactacctcatagagttgtaataaggacaaaggagttggtatttgtgaaaagattcttagggtctctagatggagtgcagcagcatgatcacttattaaataacattcttttgtgacttctcaggaaccaaggatacagtatccaattttttgttttttgtttttttttttttttgagagggagtctcgctctgtcgcccaggctggagtgcagtggcacaatctcagctcactgcaagctcagcctccccagcagctgggactacaggtgcacgccgccacacccggct

SEQ ID NO: 72122 - DNA, 2297 bp, Homo sapiens
gggctaggtagcggaggctgggttgcggacgtgcaccaaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaata

SEQ ID NO: 72123 - DNA, 1600 bp, Homo sapiens
attcattgtgcatcctttgcggggtcgtctaacccctccaagccagttttgtcatctgtaaagtgagaatgtccatatcctgatgggaggtggcctcactgtgggaggagattgagaagggcagctctcagaacaccttcacccctgatggctccggcctttcccccaggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaata

SEQ ID NO: 72124 - DNA, 484 bp, Homo sapiens
accaaagaagttgtgaagttgaaaagggctgaaagaattacccatgaaaaagtgcctgaagagtcggaagagctgcgcagtaaattcaagcgcagaacagaagagggctattatgaagccattaccgctgtggagctcaagtctcgaaagaaggatgaatcctatgaggaactcctcaggaagacaaaagatgaacttctccactggaccaaagagttaactgaagaggaaaagaaagctcttgccgaagaaggcaaaatcacgattccaacttttaaacctgacaagattgaactaagtcctagtatggaggctccaaaaatcttcgaaagaatccagagccaaacagtgggccaaggatctgatgcacacttccgggtcagagtcgtggggaaaccagaccccgaatgtgaatggtacaaaaatggtgtcaaaattgaacggtctgaccggatctactggtactggcccgaagacaatgttt

SEQ ID NO: 72125 - DNA, 539 bp, Homo sapiens
atcctagcatagggatatagcagaaaataaaactggcaaagtctctatcttaaaataccttggtttgggtggctaaaacaataaatttattcctcataatactactgaaggctgggaagtccaagattacatgctggctattgttgggttcctggtgaagaccctctccttggtttacagacaccttcttgctgtgtccacatggcagagagagagagaaagagatcagctctcttgtttctttttataagggcactgatcccattcgtaagaactctaccttcatgacctaaatagccccacaagtcaccactttctaataccatacattgaggaataggctttaacatacgaattttggggggacacaaacattcagtccgtagcaatagataaagagcaagccacataagttatctggggaaagagtgttaggcagaggtgacaccaattgcaagggccatgaaactgggagtgttccaagatgggttcaggaacagccaagaagccagtgttggctggcacggtagtttttgtga

SEQ ID NO: 72126 - DNA, 319 bp, Homo sapiens
gtctcgatttcctgacctcgtgatcggcccgcctcggcctcccaaagtgctgggattacaggcgtgagccaccgcacctggccttgaaccctttgaagtattgatgcaaaaacaagtggtcagctatggccaaattcgcaattcaaaaagatccaagaaagcaagttgaacatcctgattggagatgggacacacccaaacgtgtgtcttgaggtggctgcaaagtcctccggtctgagccagtgtaagcaggttttaccccagcccatgatttagagagatgttcagtgcagatcctgagctcagcagagagcaacat

SEQ ID NO: 72127 - DNA, 351 bp, Homo sapiens
ttagttcaccaactattgttagtatcagtgtattttatgtgtggcctaaaataattcttcttccagtgtggctcagggaagccaaaagattggccacccctggtctaaagttataagttaactaagctaatttaatatattataacccaaccaaatgaagaatgttttgacagaaatatctggtaagctgcatggacaccagaaaagaggcatccaaagccccataatttttctaggtctgtccagcacttttcctcagtgagagacatcatttctacatgatgaaaatatactggaaaggtgtagatatactcttaagaaagcgaagactaaattcctcaggcttttttg

SEQ ID NO: 72128 - DNA, 496 bp, Homo sapiens
ctggcctggttctgtggcggtggcttttcttcgctaatcatgagctgtactttgagtatgcagtagattccgtcagcatctcagtgggagataggggggaaagaggggttttaacacagtgttctctttgcattgagtgaagaagctgttgatctctgaaggaggaaaggagagactggaaccacatgaaggcttgtgctgtgaaaccctgaaaccctgacggtgccttttgatcactgtgttttaacaaagctgacaatcctcagccacacaaatcttgggaactaaaataagtattcatttaactcttgactaaaggttaaaagatacagttaaaaagaaatctaaaacccagagtggtaattccactttttctttctctttctgttgttggaacctgagctctctaggaaaactaacatttgttaagggcctgccatgtgccagattcctgtctgtaagagaggtataattattattttacactatctcaatc

SEQ ID NO: 72129 - DNA, 352 bp, Homo sapiens
gaaagagtactcagaaacctaagtctgaggctgagaacagcttggaaatggaagtaaagtgggaaagatctgctcccggtggcaaagagagccatttatttttactttgggcataaaacttacatggaaaggataatggttacaggtgaatatttttatcttgtatattatttttaaaggaacatgtgggttttttttctcccattgatgtggttgaatgaattcaaacaaatggatgcttcctttagaaatgcgatatgtgaacttgcggtcgttattttctgtctcctgaagaattggcggttgtatccttgttgaagttgaggagcttgattaatattgtaataaagcg

SEQ ID NO: 72130 - DNA, 697 bp, Homo sapiens
  misc_feature (566)..(566): n is a, c, g, or t
  misc_feature (598)..(598): n is a, c, g, or t
  misc_feature (669)..(669): n is a, c, g, or t
  misc_feature (678)..(678): n is a, c, g, or t
cacgagccaggcacatggagccatttatgtatcagatggttactgcaacagcaggatttgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcagcttttgatatgcctcatgatattgttgcatctgaagatgggactgtgtacattggagatgctcataccaacaccgtgtggaagttcaccttgactgagaaattggaacatcgatccagttaaaaagctggcattgagtccagggnaatccaaaggaagccgaggccagtttgtttgnaaacccaaaatgggaggaaccaaaccccaccttccttccaggatttgccggaggatgccaaggaggaaacnggaaactgnttccaaggagccggggttc

SEQ ID NO: 72131 - DNA, 284 bp, Homo sapiens
ttttcatttatttagatttcttcattttttttcagtaatatttcaactactgttttgttgtttttagtgtacaagtcctacactttggttagactatttttagtatgtttgaaataggatttagtttgtatcctacaaatttgctgaattcatttattatttgtttttctatgtgtgtagacagatgtattgctttaaagaaaaattaggaccagattgtttggctttcacatttgtgcctcaccacaattaatcacaatgaaatagttctgtgcgttttccga

SEQ ID NO: 72132 - DNA, 393 bp, Homo sapiens
tatgtgacacacaggctcccctttgccttccaccatgactgtaaattccctatggcctcaccagaagcagatgccagcaccccacttcctatacagcttgcagaaccaagaacaaattaaacttgttttctttataaagacagactcaggcatttatttgtatcagtgcacaaacagcctcatacactgggcatacgtgttatatcctgctttccttcaatttactattagcgtttttatgtcacaaactattcctcaaaacattattttaatgactgtataatagtccatcatttaaatatattcataacttattctgtagttaaccatccacccgtttctggacaattaggggtgtgtgtgggtgtttgttgtaataaaaaactctaaacc

SEQ ID NO: 72133 - DNA, 442 bp, Homo sapiens
atacttttttactaggtcctggggaatcaatctcaaccctcatacctgtgttggagggtgaagagtagaaaaatagagagtagtgtgatacaccttttgcacatctgtgtcacactactctcttacctcccctgccctgaccctgtccttacaagttgcagagaaccttaactgtctacagatcaaagtgcacgtttagactggcattcaggattgtcaacaatctgtatcaccatcttcaagcagtttgtactcttgtctaattgaactacttttgttttccctgtataactcccttaaatttcttttttactaagttttcccttcacctgtaatacttttccctccacctgtaatattacctcttccctactgtttttcttctttttcaatcacaatatatgtaaatcttatctaccattaaaattctattcaccacaaa

SEQ ID NO: 72134 - DNA, 377 bp, Homo sapiens
  misc_feature (19)..(19): n is a, c, g, or t
ttttttgagacggagcttngctctgtcacccaggctggagtgcagtaagcccatctctgctcactgcaagcttacaccattctcctgcctcagcttcccaagtagctgggaccacagatgcccgccaccatgcccggctaattttttgtgtgtgtgtttttagtagagatggggtttcaccatgttagccaggatggtttggccctccagcttcctctgagtcccttcataaacatttgtttatcttgtaaaataatttgttccatttctaattagtacataatgagagaggcagtgtgatggtttgtgcctaagccctttcttgccaagactttcaaagccaaaaacttcaccagttttcctagatgactagacag

SEQ ID NO: 72135 - DNA, 2508 bp, Homo sapiens
agcacatctcccggcggcgggccgcggaagcagtgcagacgcggctcctagcggatgggtgctattgtgaggcggttgtagaagttaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagcactcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatt

SEQ ID NO: 72136 - DNA, 753 bp, Homo sapiens
taacggcctaggtagcgaggcctgggtttagataaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagcactcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatt

SEQ ID NO: 72137 - DNA, 2627 bp, Homo sapiens
cagcgggttaaggcttttgatttagggagagatagttgcagggtttaaactccaattccttttcggccctgcagagtttcgtgagtgctcgcagctcatacctgtggctgtgtatccgtggccacagctggttggcgtcgccttgaaatcccaggccgtgaggagttagcgagccctgctcacactcggcgctctggttttcgttaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagcactcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatt

SEQ ID NO: 72138 - DNA, 2554 bp, Homo sapiens
agcacatctcccggcggcgggccgcggaagcagtgcagacgcggctcctagcggatgggtgctattgtgaggcggttgtagaagagtttcgtgagtgctcgcagctcatacctgtggctgtgtatccgtggccacagctggttggcgtcgccttgaaatcccaggccgtgaggagttagcgagccctgctcacactcggcgctctggttttcggtgggtgtgccctgcacctgcctcttcccccattctcattaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagcactcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatt

SEQ ID NO: 72139 - DNA, 1620 bp, Homo sapiens
tgtgtattctagttttgtcaaactgtagaaatgatgatgtggaagagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagcactcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatt

SEQ ID NO: 72140 - DNA, 2675 bp, Homo sapiens
agcacatctcccggcggcgggccgcggaagcagtgcagacgcggctcctagcggatgggtgctattgtgaggcggttgtagaagagtttcgtgagtgctcgcagctcatacctgtggctgtgtatccgtggccacagctggttggcgtcgccttgaaatcccaggccgtgaggagttagcgagccctgctcacactcggcgctctggttttcggtgggtgtgccctgcacctgcctcttcccccattctcattaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagcactcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatt

SEQ ID NO: 72141 - DNA, 2472 bp, Homo sapiens
ctgcaggaattcggcacgaggggtgctattgtgaggcggttgtagaagttaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagcactcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatt

SEQ ID NO: 72142 - DNA, 2637 bp, Homo sapiens
agcacatctcccggcggcgggccgcggaagcagtgcagacgcggctcctagcggatgggtgctattgtgaggcggttgtagaagagtttcgtgagtgctcgcagctcatacctgtggctgtgtatccgtggccacagctggttggcgtcgccttgaaatcccaggccgtgaggagttagcgagccctgctcacactcggcgctctggttttcgttaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagcactcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatt

SEQ ID NO: 72143 - DNA, 670 bp, Homo sapiens
ggaatacaatttctagaagcagtcccaaattcattggtcattcccctcaacctctaggctatgacaggtcatcccgctcttcctatgtggatgaggactgtgactccctggccctctgtgatcctctgcagaggacaaattgtgaagttgacagcctgcctgaaagctgcttcgacagcggcttgtctaccttgagagatcccaatgagtatgactcagaagtggaatacaagcaccagaggggatttcagaggtcacacggggtgcaggagagctttggaggtgatgcttcagacacagatgttcctgacataagggatgaagagacatttggtttagaagatgtggcttccgtcttagactggaagccccaagggtctgttagtgaaggcagcattgttagttcatcaagaaagcccatctcagcactctcgccccagacagacctggtagatgacaacgctaaatcttttagctcacagaaggcttacaagattgtacttgctggggacgctgcagtggggaagtctagtttcctcatgagactttgcaagaatgaatttcgagaaaatataagcgccaccctgggagttgatttccaaatgaaaaccctcattgtggatggagaacgaacagttctgcagctctgggatacagctggtcaggagag

SEQ ID NO: 72144 - DNA, 844 bp, Homo sapiens
cgatcgagctcgtaccgattacgctcctaacgtcacaccaatgctgttggtctaaggatgacactcagaaattttgtaggtgatgtttattgacatttactaggtgaaccacatagtggcatccagggttcccaccccagaccagcaaaatataaatatagttagccaaggaatttgcattttaagtacttcatatgaacaagaaaatagaagaatattaccacaagtaggcacacgtgaaaccacatgttagtattttgtctgttctatactgctgaaaatagaggaacctacttagtgctctgatgtcctattgtattggccccattttgattagttttgaaactgtgtcttcagctgaagcataaatttttgggctccttgagaagaaatgctaaatattcaaaaaatgttaagggtaaaatttaatttaaaacatgtagtcatttagttacaaaaaaaatatgtgtatatgcttttaatcagcacctaaaacaactcaaagtctgtattagagatctaagaacctacccaaaaaatactcactcaaaagtcttctgttcaagcacagtggctcactcctatgatcccagcactttgggaggccaaggtgaacggatcacttgaggccaggagtttgagaccagcctggccaacatggtgaaaccccgtctccactaaaaatacaaaaattagccaggggtggtggcggcgcctgtagtcccagctactcgggaggctgaggccggagaatcacttgaatgctaaaggtgaaggttgcagtgagctgagatcgcgccagtgcactccactttgggtagcagagcaagactctgtctcaaaa

SEQ ID NO: 72145 - DNA, 546 bp, Homo sapiens
tgtgatcacacaactgcactctagcctgtgcaaaagagtgagactctgtctccaaaaaggaaaaaaaaaaaaaaaaacagaaaagcatgttataagcacatgatgttagcttaggcaaatttaactccagcacagaacacataattaaagctgtaatatggtgatagaaagaagaatcactggtagaatttattaaaacagtttcctgggccccatcctcagaatttcttattatgtctgggtgtggctcatttctaataagcttgcaggtcacaccaatgctgttggtctaaggatgacactcagaaattttgtaggtgatgtttattgacatttactaggtgaaccacatagtggcatccagggttcccaccccagaccagcaaaatataaatatagttagccaaggaatttgcattttaagtacttcatatgaacaagaaaatagaagaataatcctagcattttgggaggccagaataggagtatcacttgagcccaggagttcaagacgactctgtgcaacataacaagaccccgtctcta

SEQ ID NO: 72146 - DNA, 1294 bp, Homo sapiens
tgtgatcacacaactgcactctagcctgtgcaaaagagtgagactctgtctccaaaaaggaaaaaaaaaaaaaaaaacagaaaagcatgttataagcacatgatgttagcttaggcaaatttaactccagcacagaacacgtaattttaagtccttaggaaggacttcaagatattaagatacagaacagtttatactcctcaaaattgtcacatttgccagaagacaacccctggccttcaagatggcatgaaaatgctagttctgatatatatcactaacctggaatttgtccataatgttgcatagcacataaccagttcctagctagggtgtcaaacaccaaagaaagataattaaagctgtaatatggtgatagaaagaagaatcactggtagaatttattaaaacagtttcctgggccccatcctcagaatttcttattatgtctgggtgtggctcatttctaataagcttgcaggtcacaccaatgctgttggtctaaggatgacactcagaaattttgtaggtgatgtttattgacatttactaggtgaaccacatagtggcatccagggttcccaccccagaccagcaaaatataaatatagttagccaaggaatttgcattttaagtacttcatatgaacaagaaaatagaagaatattaccacaagtaggcacacgtgaaaccacatgttagtattttgtctgttctatactgctgaaaatagaggaacctacttagtgctctgatgtcctattgtattggccccattttgattagttttgaaactgtgtcttcagctgaagcataaatttttgggctccttgagaagaaatgctaaatattcaaaaaatgttaagggtaaaatttaatttaaaacatgtagtcatttagttacaaaaaaaatatgtgtatatgcttttaatcagcacctaaaacaactcaaagtctgtattagagatctaagaacctacccaaaaaatactcactcaaaagtcttctgttcaagcacagtggctcactcctatgatcccagcactttgggaggccaaggtgaacggatcacttgaggccaggagtttgagaccagcctggccaacatggtgaaaccccgtctccactaaaaatacaaaaattagccaggggtggtggcggcgcctgtagtcccagctactcgggaggctgaggccggagaatcacttgaatgctaaaggtgaaggttgcagtgagctgagatcgcgccagtgcactccactttgggtagcagagcaagactctgtctcaaaa

SEQ ID NO: 72147 - DNA, 442 bp, Homo sapiens
  misc_feature (11)..(12): n is a, c, g, or t
aattcggcacnnagggggacctgccacccccagaaactgaagaaatccctcttcatgctgaaagagctcaccaacaaattcaggcagcctgtgaaacgtttgatgtccgaagccaacagcacattcagatccccaagctctacacctccaatgtgacctggggcttgcaccacttcaggctcgtgcaggactcacagcctttggacctcagctaagggacctgcttctctgtagcacatggggcttgtttgtgttggggtctgagccctgagctcatggtcaaggagaaccccaggtccttctgaacagagacagctggcctcggggcctccctctcactgcatgcaagagcctgttagggcacaagactcaaggcgctgagggaggctgtttcaggagggagccgcagaaggatggtggagagagaaggggacagcatccg

SEQ ID NO: 72148 - DNA, 644 bp, Homo sapiens
tttattttgaggtccctatgggctaccccttatctggatgaaggatttttggcccttggccaacgaaatgctgaggtgaattggcccgaggccggagcagatgggtgccctatgcagatgaaggtgtggccggtgcttggccatggccactcctgggctctttccctttctgagacgtggtggaaggaggagggcggtagggacagcggcctttgatcctttgttactccggatggggagatggggtttttcctttttgtctagttttagaaagtttgccttaattggccttagattcgctgcccccagacccaggacccaggtatttcttttttattcttttttattggagatggggtctcactctgttgcccaggcgggagagcggtgacaggatcacagctcactgcatcatcaacatcctatgctcaagcgatcctgtcacctcagcctgcagagtagctgggaccacagccgcgcgccaccacaccgcgctaatttttgtgtacttggtagagacgggcttttgccttgttgctcaggctggtctccaactccagggctcaagcgatccagctgtatcgccctcccaaaatgctggaattacaggcatgagccaccatgcccgccttgtttcttaatta

SEQ ID NO: 72149 - DNA, 469 bp, Homo sapiens
aatggaatagtgcctcacctcgcaatactaacattgaatgtaaatgtcctaaatgctccacttaaaagatacagaattgcagaatgggtaagaatccaccagccaactatctgctgccttcaagagactcccctaacacataaggactcacataaacttaagttaaaggggtggaaaagacattccatgcaaatggacaccaaaagggagcaggagtagctattcttttatcagacaaaacaaactttaagacaacagctatttaaaaagacaaagagggacattatgtaatgataaaacctcttgtccaacaggaaaatattacaatcctaaatatacatgcacctaacactggaggttccaaatttataaaacaattactactatacctaagaaatcagattgacagcaacacaatagtagtaggggacttcaatactccactgacagcactagataggtcaccaag

SEQ ID NO: 72150 - DNA, 1501 bp, Homo sapiens
ctgcagtgtagtggtgatcatagctcactgcagccttgaacccctgagctcaagtgatcctcctgcaatgggcttccaaggtgctgggattacaggtgtgagccactacgcccagcctcattgagagttgtaaacagccactttttctttatttatactttagaaaaaccttggacatagcagtaagtggattttgactattgctgtaccttaagcatctgccagtcaaaagaaggcatctcatctaatgattttgagatgtcttagggacttccgttcctaaaggatgagataactcgggtagggtaacagtagcttggataggctgataagctaatgagttttccttttttcctttctcttttttactttttatttgaaagtagtgttaagaatattgtgtcttgaattcaggaaagaataaaagtaacactagtaaggtagaaaaggattaaacactgagaaagtaaaaaaaccaggtgaacaggtttttgaaaccaaccttggtgatggaaatttactggctttacaagaaaaagaaatattgcaacgactaataacatcaatccttccattgttgaatcagagaccttaggatgtacactgcatggataagcttgaaataagataattttcattccaaaaggattgttgctattacactgatgataaaatggctattagtcttaatagagtagggtgagccagaatatccctgtatagaataggtatctgcttgagtatgcttttgtaaactgccttatagtacactatgaacaaaaggacataactttggaactatatagagtttgaatcccagctccatcccttcaggcaccctggccaagtatcaacttctctaagacttggtttcctcacctgacttgccttgaggtgaagtttaaatataaaattttctagcctagtgcctgattatcaataggcattcctatcaatgctgtttcctgtagagatttaagtaataatattataagggttttagaaggattccttggttaatatctatcatatatttatatagagagtttcataatctcacagtaaaatgttttaaaacatttggagtcctcattactaatagagaaagaaggaaagtttctatttacaggtaacatgattgttatgcttgtcaggcaagaatatgagaagtaataagagtacagcaagttttctggatctatgatcaggcaaaggccgggagcggtggctcatgcctgtaatccctgcactttgggaggccgaggtgggcagatcacttgaggttgggaattcgagaccagcctgaccaacatggagaaaccccgtctctactaaaactacaaaattagccaggcgtggtggtgcatgcctgtaatcccagctactcgggaggctgaggcaggagaatagcttgaatccaggaggtggaggttgcggtgagccaagatcgcgccattgcactccagcctgggcgacaagagtgaaactccgtctcaaaaaa

SEQ ID NO: 72151 - DNA, 1095 bp, Homo sapiens
gctggattttagcaataaaagattttctgttcgtgtattactaacagttaagctactgtatcctcatcaaaactatcttctaaatagaaagtaatatgtagttcaagtgtttaatgttctgtcaaaaattatatttaacatatgaatgcacatgtgtgctttgaaaaaaaatttaaaatgaaggagactttacctaataagattattctgtgtaagcaatgtggaaagaagaaaaactaatataaagtattggcagtttggaattggacatctgactccggataattggagtactgatagctgttatagttaaaagttatagttaaaagcatacttgtcccctgtaaatacttactctttaagaaattttcatcttctcattttattcatttattctgcaaatactgggtgcccaatatatgtcagacacagttctagatgctagggagacagtagtgaacaagtccttccctaacctaaggtagatactgttccagcttttctagaaactagtcgaattaaagttgagctacatacaaacttagcatctctgggaaagagaaaatatttgacaaaggtgaattggggccttttttaacgctcatctcttcctgtaacatctctgtttagggaaggtgggaaccctggaaaaagttacataaaatgtatttattgttaaatgtgtttagtctcataagaaaagcagtctttcacttggtaatcctaatactgtccttgaactaggttagtctattttaagcatggcaggctacttttggtcttgagttattttagcttaaattaactcaagctaatttaagtttacagctgcacataaagtattatgtaatgacttgctttagggccttatcattcaaacaccagttaacttttccagaccagtagaggatcgtttgtccttattaagtgaaaacgctagtgacctacaggtgtctttgatgccttttgaatacatcattcgctacattcaagctaattatgcggaagtctttagaataggatttatagctgaaatgaaatgatcaataataggaacatactactgtttcattccaaagcctttggtaagtggga

SEQ ID NO: 72152 - DNA, 851 bp, Homo sapiens
ctccccaggggccacagcagactaggggcttctggattataaaacggagaagtgggcgctcctcgccaaaaaaggctaccaggagcgggacctggaaccccagatttccatcacaaccaaactcaaaggggtttccgtgactcagatcaaggagcttggaaaccggctgtgggatgtggccgacttcgtgaagccacctcagggagagaacgtgttcttcttggtgaccaacttccttgtgacgccagcccaagatcagggcagatgcccagagatacagggtcttgctatgttgcccaggctggagtgaagaggctattcacaggtatgatcaagctcactgcagccttgagcctcctaggctcaagccatcctcccaactcagccttctgagtaactgagactacaggcgtgtaccaccattcccagctaataaagtctatttttaaaaaatcaaaaaaaaaaaaaaaaaaaaaaaaaaaaaaaaaaaaaaaaaaaaaacaaaaacaaaaacaaaaaacagggggggcacaaaaaagagacccgagaggggcacaaaaataagagcaacaacatatgtggagacaggggcccaaagagagggcgaaaatacgagcaaagaaacgggccagaaaaaacagacccgcagagggaaacacggcccccgcggaactatggaagagagccccacaccacgcgaggagggcacaaacaagcggcgaaacagcaacacgagagagagacaacccccaggggccacacaaacacaacggggcacacaagcggcgcaagcagcgagacaaagcgacgcagtagaaagaggagaaagagaacggacggaaaactcacgg

SEQ ID NO: 72153 - DNA, 481 bp, Homo sapiens
ctaataaataaataatttatttatatatttatttattaataaatatgagcccaagcaacccaatgttgtttgtagtagaagtcatggctggcctgcgctgagcatcccacagctagtggtggtagctaatcctgccagagtcaggcctctgcctgtctgatgccaaattgcatgctgtgtcttttaacctggattgcaggccacaaatgttttgtaaacattttacgggagaaaaaaccgagatagttctaaattccatacatccattagcttagtttttcctgtggattgggaaaacccggctctgatttcatttcagggtgggacagcccttggtgcactgtctggcgggattttgcattttatcctgatgcttccaggagcaatgaagggaaggcagggggctggaggcgccccgcaggcgggtacgttccctgctggccttagccccagcccgcctcccccaacccctgcgggagaa

SEQ ID NO: 72154 - DNA, 1002 bp, Homo sapiens
ctaataaataaataatttatttatatatttatttattaataaatatgagcccaagcaacccaatgttgtttgtagtagaagtcatggctggcctgcgctgagcatcccacagctagtggtggtagctaatcctgccagagtcaggcctctgcctgtctgatgccaaattgcatgctgtgtcttttaacctggattgcaggccacaaatgttttgtaaacattttacgggagaaaaaaccgagatagttctaaattccatacatccattagcttagtttttcctgtggattgggaaaacccggctctgatttcatttcagggtgggacagcccttggtgcactgtctggcgggattttgcattttatcctgatgcttccaggagcaatgaagggaaggcagggggctggaggcgccccgcaggcggatacagggtcttgctatgttgcccaggctggagtgaagaggctattcacaggtatgatcaagctcactgcagccttgagcctcctaggctcaagccatcctcccaactcagccttctgagtaactgagactacaggcgtgtaccaccattcccagctaataaagtctatttttaaaaaatcaaaaaaaaaaaaaaaaaaaaaaaaaaaaaaaaaaaaaaaaaaaaaacaaaaacaaaaacaaaaaacagggggggcacaaaaaagagacccgagaggggcacaaaaataagagcaacaacatatgtggagacaggggcccaaagagagggcgaaaatacgagcaaagaaacgggccagaaaaaacagacccgcagagggaaacacggcccccgcggaactatggaagagagccccacaccacgcgaggagggcacaaacaagcggcgaaacagcaacacgagagagagacaacccccaggggccacacaaacacaacggggcacacaagcggcgcaagcagcgagacaaagcgacgcagtagaaagaggagaaagagaacggacggaaaactcacgg

SEQ ID NO: 72155 - DNA, 265 bp, Homo sapiens
ggcgaaggttgcagtgagccgagatcacaccactgcactccagcctgggtgacagagtgagactttgtctcaaaaaaaagaaaaaaaaaattaaaaacagtaggcaactgtagcacaatggtaaggacttgtgtgtctaagcctagaaaaggagcagtaagacacagcattatactctgatggggccactgccgattatgtggtttgctgttgtcagaaacgtcaagatgtggcgtgtggctgtattacagatgcacaactgtgg

SEQ ID NO: 72156 - DNA, 415 bp, Homo sapiens
gccactgcactccagtgtgggcaacagaacaagactctgtctctacaaaaaaaaaaaaaaatacgtgtaacgaacaatttgccactgtaaccatttttaagcgtacaattcagtggcattgattacgttcacgatattgtgcaaccatcgccccattaccaaaactttttcatcatcccaaacggaaactcggatgatttctttttctttttttgtgatttcttaaatgagcctgcaatgtaacaaagtttcacagtattgtaggtacacatggaaaaatgcaatgaatattggctcatgcctgtaatcccagcctcccaaagtgctgggattataggtgtgagccaccgcgcccggccctccatgatgattttattttctaaatattttgtctggagatacatagcacgcagat

SEQ ID NO: 72157 - DNA, 1168 bp, Homo sapiens
gaggcagtgatcagggaatctcaatgagggtgagactgcgacaaagacttgaaaaaggtggagaagcaagccttgtgggtatttagggtagcagtagtccaggcaaggggaacaactagtgcaaaggctctaggaggcaatgtgtttgaagtgttttaagaacagtaaggaggctagtatggttagaacagaatgagcaaagggggcaaagtggtagaaggtgagatcaaagaggtaatgaggccattgtggaggcccatatggactattggaagggctttggcttttactctaaatgaggcaaaaaccattttaagcagagaggagtgatatgacttgatttcttgttaaaaggattattctagttgctgttacagaaaaagattacaggggtgcaaagaaacagggagacaaaagaatataagattttcactgtaacttatatctagtatgcttgcttatacttgaaaatgcatatccagataattgtagtaaattcaaatattatgtttatttaatagtactaacattgatatgctggttaattatgattaggagcactaataaagcacaaatcagggattcccaaaaagaatgttgaaagggcagtcagcttttcctgtgccagaaatcaaagtcatagcagatttggggcaaatatgtcaaagtcaaacttacgcacatcactactgagaagacaaagatgaatgtgtgacagtttcctgcccccaagaatctttaagcattgtgaaggaagattaatatagccaaataactagagtgatcagttctaccagagaggaccagttttggaagccagaggaaaaaaaaaaaaaaacagaaacaaaatgatgtttgaattaaatctttaaaagtttctcttataaatttaccaagccacatattgggaatggtaccccaggcagaaggagtagagtaagcaagccagaaaggaaatactatggtgcttttgagtaactgcagtgtggctgaagaatgtggaaaatgatgaggataaagaggtggacagggaactaggtaagggagggcttccttttaaataattagaccttgtcctgtgtacatttaatgggattttaatcaggccataatgccaaatttctttacttcggaaggatctttatggtgatggtttcagaaaaaaaaa

SEQ ID NO: 72158 - DNA, 1371 bp, Homo sapiens
  misc_feature (116)..(116): n is a, c, g, or t
  misc_feature (761)..(761): n is a, c, g, or t
  misc_feature (771)..(771): n is a, c, g, or t
  misc_feature (794)..(795): n is a, c, g, or t
  misc_feature (840)..(840): n is a, c, g, or t
  misc_feature (921)..(921): n is a, c, g, or t
  misc_feature (929)..(929): n is a, c, g, or t
  misc_feature (937)..(937): n is a, c, g, or t
  misc_feature (941)..(941): n is a, c, g, or t
  misc_feature (987)..(987): n is a, c, g, or t
  misc_feature (1036)..(1036): n is a, c, g, or t
  misc_feature (1156)..(1156): n is a, c, g, or t
actctgtgtaactaggataagctggctttggaagaggcaagccgttctttcactagaagggagaggttattgcatcacccatcagcaagagaggaattcaggagaggtagagagcngtgtggggtttgggtggcagccagctactttccaaaacttcccaggggctgcaatacagccgccaacccaaatgtcattgggataggccagcgtgccagatgccatcacagaaaataacttcccttgcctggcatctgggttcttgccttgtaatccagaagaccacatgctggatcagctggtcccagcggggaccatgagctcttccgtcctctctccctccctgtctgctgagcatttgaatgagtcatcagagtgcagaatggattttggccatgcccttaattgagtgttctgtacatacaataataattaataataatttgaactgatccttctatagttttgtctctggaccaggcactgctctaaaggctgcacagattgtaactcatttacatatgtaacacatatctacatatctcattagcctgaagcacaatagaatgagaaaagtgaaaagcaaagtgcttagactctagatttggaccaactggcttcctatgtcaactctgcctctttcagtataggtgactttagaaagtaaattctgctttctcaagccaagcgtccatgcacagacaagggaataaacaaaacgtggtgtatactggaatattattcagccttagaaatgaaggagnttctggccgnctgtgtggtggctctagcctgcnntcccaacactttgggagggtgaggcggacagatcacttgaggtcnggggtttgagaccagcatggccaacgtggtgaaaactcaactactcaaaatagaaaaattagctggacatggtggcacacncctgtgangccagctnctcnggaggctgaagcatgagaattgcttgaaccctggagatggaggttncagtgagcccacgtcgcgtccctgcacgcaagcctaggcaagaaagcangaccctgtctcaaaaaaagaaaagagatgctgatacatgctacaacatagatgaaccttgaggacattattctaagtgaaatgagcttgtcacaaaagaacaaatattgcatgattccanttatatgaggtgcccatagttgtcaaattcacaaagacaaaaagtggcatggtcgttaccaagggctgggagaaaagaggaatggtgagttagtgtttaattggtacagagtttcagttttgcaagatgaaaagagttctggagatgaatgttgggaatggctgtgcaacactgtgaatgtacttaacactactcaactgcagacttaaaatggt

SEQ ID NO: 72159 - DNA, 1415 bp, Homo sapiens
tttgggaactcatttctaaattattttttatttttttatttttactgaaccagcaacccagtaaggaatgatctggaagaaacgcttggccaggtgttgtggcgcgcgcctgtagtcccagctactttggaggctgaggcaagaggatcgctgttcgaggctactgtaagctatgattgtgccactgcactccagcatggggaatagagtgagacctagtctcaaaaaaaaaacaacaaaaaaaaaaacaggagagaaaaagaaaagctgttttatcttcccttaccttcccagaatctataccttgaaaaaaggaactgttaaaaaaaaaaaagccagtgtgtttaggttttgacagcagtgcatgcaagcttctctcttaattcagctcctcttaattcactctgcacctgcatctgatttgcaaaagatgaagcgtaaaatttcaaaatagcaagtgtttgttacagtgttaacatgtggctcagtgctctatgcaatagaccatgttgccttgcaaattttccttagccaagtgtaattgttactgtagcaaatctactttaatgctacttgaaatgaacagttcgtagttattagactggaacctcaagtagctgcaaccgctagaaactcctccggtggttcccccctccctggtctctccagagggaagaaggtcaccttctacacttaactaccatgctcattcatctggacgaaatgcccagtccactgtcttcttcacgcgttattctccaggacagggctcctccgccgcgcacgttatttcctgtagagcgggcacgaaattaagcaccttgaagaccagcggtagacacagattatctccggttccaagcacgtctcccgctaggaacttttttcacttgtcactcttctgctgctttttgaggaaaacaggtgatatttggtttcctgccagagtcttcgtcactctcgtaactatgatgtctgggtaaaaatagctcacatttttgcttaaaaaataacggccgcgcaaatttatggttagatttgtctcaagtctgaagaccgcgcatcctaactagtgaggcggaagacacctaaggagccaggagctgtcgccgaggcgaggctgcggagacgttcccttggtgggccgcgggaccacccaccccgccagaaactcggttcgctcaccctaagaattttggggcaactggacttctccaccgcccgcttccggacccgctccggcgccgcttccggacccactcctcggcgagcgcaggaactcgctctcccagcaggccccgcgcggtgcgcctctcggcgcgttccgggtcctatgacagctcggctcgcatgcgccacctacggccccacccgcggccccaccccctggctcccggctccttccccgactcccg

SEQ ID NO: 72160 - DNA, 856 bp, Homo sapiens
gctagtagaggccgcggttaaatcggacgaggtattattagactggaacctcaagtagctgcaaccgctagaaactcctccggtggttcccccctccctggtctctccagagggaagaaggtcaccttctacacttaactaccatgctcattcatctggacgaaatgcccagtccactgtcttcttcacgcgttattctccaggacagggctcctccgccgcgcacgttatttcctgtagagcgggcacgaaattaagcaccttgaagaccagcggtagacacagattatctccggttccaagcacgtctcccgctaggaacttttttcacttgtcactcttctgctgctttttgaggaaaacaggtgatatttggtttcctgccagagtcttcgtcactctcgtaactatgatgtctgggtaaaaatagctcacatttttgcttaaaaaataacggccgcgcaaatttatggttagatttgtctcaagtctgaagaccgcgcatcctaactagtgaggcggaagacacctaaggagccaggagctgtcgccgaggcgaggctgcggagacgttcccttggtgggccgcgggaccacccaccccgccagaaactcggttcgctcaccctaagaattttggggcaactggacttctccaccgcccgcttccggacccgctccggcgccgcttccggacccactcctcggcgagcgcaggaactcgctctcccagcaggccccgcgcggtgcgcctctcggcgcgttccgggtcctatgacagctcggctcgcatgcgccacctacggccccacccgcggccccaccccctggctcccggctccttccccgactcccg

SEQ ID NO: 72161 - DNA, 1044 bp, Homo sapiens
  misc_feature (32)..(32): n is a, c, g, or t
  misc_feature (129)..(129): n is a, c, g, or t
  misc_feature (433)..(433): n is a, c, g, or t
  misc_feature (450)..(450): n is a, c, g, or t
  misc_feature (464)..(464): n is a, c, g, or t
  misc_feature (567)..(567): n is a, c, g, or t
  misc_feature (605)..(606): n is a, c, g, or t
  misc_feature (773)..(774): n is a, c, g, or t
  misc_feature (927)..(927): n is a, c, g, or t
tcgagtaatagtagtaatagtagaataggttnccgtacagctggctctgtgtgaattaaaccctttttctattgcaattcccctgtcttggtaaatcggctctgtctaggcggacaaggagaatccatngggcggttataagagctgccccccaatttcaaatatttatatctaagctttctttattttcctgcctatttcccaacaagggatgaggagcttagggagttaaaaagtagtaaaatatggggaaaagggcataattcccattataccaagaggcattgctggtgaagcaatacctttccaggtacgattttcagtaacacagacgtgcagtaagaggcagtgttggctgttagtgtcttttatgagccagtcttttcctggcttgctatccgtggtgagactgacacccaaatgttctctcagngtctctttcagggtggnacaacagcttcagngtctttacgtatgtctcctcccaacatgaagctaattgctgtgctctcgggcatgtttagctcttggtagagtggctttcctaacaaatagggagcagtgagnccagcctgaagtttttatttagtcactccttagaatcnntgatattttgaatactgaagtatttccagtggctagtaatttactaagacaaaagatgcccctgtttgcatatggaaaacagaaggggagagagccaggaggtgtgggtgagagccccgaaggcaagaggatcccaggggctggcccagcacggagctggtagacanngcgctcacaccagggagggctgcaccctcctttctcccgtctgtgttttctttcccttgcaagtgttattcgacaaaagcaattatgctaatttccttcctgtgggctcaattccttttttgacacgatgacttggaggagtcattatgattnctccaaacaggaaagacactcgcccagctgtccgcccgcagagagctggctacggtgcagaaagctgaggaggcgtctggagtttttgggtgttaatgattctgcctgcccacaggt

SEQ ID NO: 72162 - DNA, 276 bp, Homo sapiens
taatctttgcaataactcacaaggtaggttttaccagttgcagtttcctgaggaggaaaccaaagctgggaattattttatcctcaaagtggcaataagttgttggccacaaccgggatattccgcttttctcctcacatttagaaatgtcatgtggctgtgagtcaccttgtgaggatcttgtcacatccttagactgtactgccaacactgaaaatgcactgtggctgacccgtttaagcaaagccaggctgcaattttcctgtggattcccat

SEQ ID NO: 72163 - DNA, 344 bp, Homo sapiens
ttctgccatagggactcgatctgtcctccccactccaggacagctttaaaggttgatggttgctcttgatggtatggcagggagaatgtcccacaccacctgtcccttggcaccccggggcacgtcggggacgggaggggcaggggctgctgcccactgccagccgaatggcatgatgaatggagctgtccctcttccccacggagcctttgatctccccctcgtggggagggggccaggggcatcaaagacatttttgtggcattagaaaatctgataaacgccatctcacctgcagctggctctcccaccccttctacccgggccaggttgggggaggaact

SEQ ID NO: 72164 - DNA, 693 bp, Homo sapiens
aagaggggagaatggtcagggaattcttctgtcgcccttaacctgctgcagaccaaggccctgtcagggctgcatccttctatgactgagttcctccagggctgccactctcacagggcttagggttgtaacactgtctcttcctttcgtctgttcaaaaggaggaggaggggtgactctctgctctttcttgtaccctgtgtgtcactatcccttattgattctccttactttgcccactctctcataaatggtcctttaggcaatggaattgttttctgccagaactctgattgtttgaccttttaatcaattgcagagtaaatgcatgtgatagcaaacatttaagcatacctttagaaagacccagtacggtagatgtacctgaatgtgtgtttcaagttaggcaatctgtgcatggccaacctggagattcgtttttttatctatacatctgagcccccacccagcctgttccatggaatatgtgccgtacaggagattgaggccttgagttttgagttaaatgatggttgccaggtggagttctttcgatggagggtgttaagtgaaagtgctgtagaaactgcataatgtttgcaagcagttgtgttctcccagccagcctgccactactggactctctcttctgtattaaccccctaataaaacaccgcatttcatctgctggct

SEQ ID NO: 72165 - DNA, 189 bp, Homo sapiens
  misc_feature (166)..(167): n is a, c, g, or t
tcctaaaatataccaagctcattcttgcagcagggcctttgcattggctatttgatccatctagaaaatgctttgtgtgtgtgtgtgtgtggtgtgtgtgtgtgtgtgtgtgtgtgtgtgtgtgtgtgtgtttcccatgactgctttctaatcattcaggctttanntcacatgttactcttcacaaag

SEQ ID NO: 72166 - DNA, 309 bp, Homo sapiens
ctgtgcttttggagagtggatgtgctaaaattagtaagagtctcagtgcatagatttgacaagagttttagccaaaactagaagatagttgagaaagataattaaattgtcatgtcattcagaaagtagagtggtgtttgccagggcctggaaggagggggtaatagggagttcctgtttaaatggcacagagtttcagttggggaagatgaaaacattctggagatggatggcggtgatggttgcacaacagtgtgaatgtacttaatgccacagaatggtacacttaaaaatggttaaaatagtagg

SEQ ID NO: 72167 - DNA, 404 bp, Homo sapiens
gaactagctagggccacttgcctaaagttaaccacctctttttaatcaaaactgagcaaaacattcattccatttcatggtgtttcaacgtgtacctttttagaaagatgaagtaaggaaaactaaccctaaatcaactattaaagcccattgaagtgtgcttgtttgcatatttttgctttatatggataacacgctcctgagagctgcagaacatgaacttctaggctgaatgagatacagggttgcagctgatgctttctggtatagcccattcagaactcacatggcatctaaagtgttactgatgggtctgtcattgatcagcactacttggatatttgcgtgaacaaagaggttcagaagtattgaatctggaaactcgtaggagttcaaggccaatt

SEQ ID NO: 72168 - DNA, 1004 bp, Homo sapiens
gaacaacagttgtgtccatatgcaataacagtgtttcaaattctttggggatttgcccacagtgtctgcagtcatattgtgacaccagttgtgatgccagtctctgtaaatcagacttattcccagtgagacattatatatttttgcagccaatacgatctattttatagcgatttatagcattgtctctgaaaaggatactttgatttgtgtcttgtttttgtcagttttcaacactttgattgtggcccaggttaattaatattttgtgtctaggtttcctcatctctaaaataaagatgtttatttctatagcttcatgttgacaattaaattatataatttatgttactcaactagcaagtaaattgatgtacagtgtatttataaatgatagatactatctttatgttaatttttattattgtcatcattatcatcaattttcaggtccgtgttctgactaaaaggaagccacactctgtcgaaaacaagctttgtaagaaaattttgaagtatttacttatatctaaccattcattccaccttttctcccaaataacactctaatatcttgagacatcttgtctagggccagatttcataaatgcttgtgaggcaggagaataagttccagaggcagttcacactgcctaaagccaattcacactgacttcctataactaaatctaaaggaaaatctcaactttcctcgcccaagtaacaaaagaatcagaggttatactccctttgcaacctgccccttttctgcctggcagatgaaaaatgaaaagtacctatgactggtcccctcccacgaccagccagactggtcacggatcactacttcatttacatagggcgtaaaccgagtaaccaatgggaaacctctagagggtatttaaaccccagaaaattctgtaaccggtggtctccagcaggttgctcaatcttgctgccactctgtgggatgtacttttgtttcaataaatctgtgctcttcc

SEQ ID NO: 72169 - DNA, 489 bp, Homo sapiens
catctcaaaaaaagaaaaagaaaaagataaatcagaagaggaaagaagttctagatgatagagaagaagccttgtgggtgaaaggaatgcaagccgcctgggctgggtagagcggggcgtgccgccagcacccttccccaggggctgcacccggggccggagctcctgctgcacagccagaagcaagctatgcaccttcgcaacgccgagacacgtcgtctgtcatgagttcacttccagatcgtccttgccagtgtctgccatgtgctgtgtgtctgtgagaccctggcagtctgtcaggttaggggccatggacgtggaccaagtcctttcctgataccctggatccctacagatcccttgttatagctaaaaatacacattcttttctcagacaagtattcattttgtaaattacataccttggtagtcaaccttttaaaatctaatttttcaactttctttcttctgtaatgattggaaattctg

SEQ ID NO: 72170 - DNA, 997 bp, Homo sapiens
attatttatgaggatggcctgtgcaaaaagacacccagagatttcatgctgttgattcacagaaagcctgttcctcttcactccgtagagtcctcagagtctggatcatcccttacagaagatccttgataatatttctgatatacctccaaggttccgtttgtcaaatgtgtgcgacccttctgataagtcaccagaggtgatgagggagagagagaaagaaagcaaattacaactgtaaagagtctctgaacagtgaaagatcaaaacagacagtctctggctttactggatgagtcaccattgcagcccgaccgcaaaaacaagcgtggcttctgtacttagcagcagtcttcctgtctggaaaggaaacattgctcagattggagatactggccattttatagacttcaaagcaacttaggccactgaactgtcaggcgggaaaacaggatgtcttccatttggaagcccctttgcttctaagaagttccagagaccatcccaggcccacagagttataaggattcatctgggcactgaagacatttgggacctcagtgaagtttctccgaggccagatggtcacattgattttctggaatcattttgaataaaaatgagcgaggtggtgaacacaatgcaaggctctccacgtactgtctggtattgttcaaccagctccacgactccctgagggcagagatgagcagatgttaatggataaagccaggtgggatgatgttataacatttctcctacagccccaaatctcccaactcctgcatgtgtgacctgagtaagactcggtgcaagaagacatcagtgttcccatctgtgaaatgaaggaattgacccccgaggatcttccatttctgacagtgctttggatttcattggttttgtcacaggtaccccccaaaagcctccatctttggataagtgattaaaactgctgagtaattttcaattaataaaagttcagtgctggctctca

SEQ ID NO: 72171 - DNA, 1026 bp, Homo sapiens
attatttatgaggatggcctgtgcaaaaagacacccagagatttcatgctgttgattcacagaaagcctgttcctcttcactccgtagagtcctcagagtctggatcatcccttacagaagatccttgataatatttctgatatacctccaaggttccgtttgtcaaatgtgtgcgacccttctgataagtcaccagaggtgatgagggagagagagaaagaaagcaaattacaactgtaaagagtctctgaacagtgaaagatcaaaacagacagtctctggctttactggatgagtcaccattgcagcccgaccgcaaaaacaagcgtggcttctgtacttagcagcagtcttcctgtctggaaaggaaacattgctcagattggagatactggccattttatagacttcaaagcaacttaggccactgaactgtcaggcgggaaaacaggatgtcttccatttggaagcccctttgcttctaagaagttccagagaccatcccaggcccacagagttataaggattcatctgggcactgaagacatttgggacctcagtgaagtttctccgaggccagatggtcacattgattttctggaatcattttgaataaaaatgagcgaggtggtgaacacaatgcaaggctctccacgtactgtctggtattgttcaaccagctccacgactccctgagggcagagatgagcagatgttaatggataaagccaggtgggatgatgttataacatttctcctacagccccaaatctcccaactcctgcatgtgtgacctgagtaagactcggtgcaagaagacatcagtgttcccatctgtgaaatgaaggaattgacccccgaggatcttccatttctgacagtgctttggatttcattggttttgtcacaggtaccccccaaaagcctccatctttggataagtgattaaaactgctgagtaattttcataaaataaagctgtgtcgcccggaggttttttttttttggtggaatgatatatataa

SEQ ID NO: 72172 - DNA, 899 bp, Homo sapiens
attatttatgaggatggcctgtgcaaaaagacacccagagatttcatgctgttgattcacagaaagcctgttcctcttcactccgtagagtcctcagagtctggatcatcccttacagaagatccttgataatatttctgatatacctccaaggttccgtttgtcaaatgtgtgcgacccttctgataagtcaccagaggtgatgagggagagagagaaagaaagcaaattacaactgtaaagagtctctgaacagtgaaagatcaaaacagacagtctctggctttactggatgagtcaccattgcagcccgaccgcaaaaacaagcgtggcttctgtacttagcagcagtcttcctgtctggaaaggaaacattgctcagattggagatactggccattttatagacttcaaagcaacttaggccactgaactgtcaggcgggaaaacaggatgtcttccatttggaagcccctttgcttctaagaagttccagagaccatcccaggcccacagagttataaggattcatctgggcactgaagacatttgggacctcagtgaagtttctccgaggccagatggtcacattgattttctggaatcattttgaataaaaatgagcgaggtggtgaacacaatgcaaggctctccacgtactgtctgccccaaatctcccaactcctgcatgtgtgacctgagtaagactcggtgcaagaagacatcagtgttcccatctgtgaaatgaaggaattgacccccgaggatcttccatttctgacagtgctttggatttcattggttttgtcacaggtaccccccaaaagcctccatctttggataagtgattaaaactgctgagtaattttcaattaataaaagttcagtgctggctctca

SEQ ID NO: 72173 - DNA, 447 bp, Homo sapiens
tattctctctttttttttttggcttctgtacttatttcagaaagtagattgtggttagtaacgtacaactttcctggaattaaaaaagaagaaaatatgaggattcagactatatctaaggtcttattttatttagcactaaaagccctctatgcttatctacacgaacaaccctgataacctacacaggtacttcccaaacctgcctatgcttcagaatcaccttcaaacacttgataaatatgcaggtttgtgttcaaaatacagtccacttgttttgaaaaaaagagcccttgaggactttgacatgcagccagctgagtgctgagcaaagctctggctttggggagtgtggccttgacaactgcacaggggactgcacaagggcattgtttatgtcactactgaagccattttgcacttggattgtgaagtccccacactgac

SEQ ID NO: 72174 - DNA, 836 bp, Homo sapiens
agccttatatacggagtcacctctccccagagaggtcacagccaacattcagaggcctcccagggccccctctccctggataaaccacttcagctgccccccatttttctcgagggagaaaaaggggaatcctctgtccagaatgagcaggaaggagagccaagcctacagtcacccagcttagagctccagtcccctgcgtggccacgccatgcaggagtggctcaggagcccctgaaagtgtccagcagctacctcagtgacacccagagcagcgagagtcatgtttccagcgtgcagcacccgaggccagaggagggcagccatgccagcctgagcagcgggtacgcaggggacaaggagggcagcgacatcagcttggtgggcagccaccggagagtgcggctgaacagaaggctcaacacccaggcggccagtaaccaaaccagccagctgggctccatagaccctcccagctctctaaagagccggctgactggccccgcccacagcaccaagcagactggagggaaagagtgaggccagcctgcccggcagcggcagcggcagcagcatcctgtccagcgccagcttcatcagcttgggcagcagtgccctcacctaccaggtgagcagcgggctgctgacttccacagccagccttccctccacccaggccagcagccgtcagagcgtccggctggatggcagtgcccaaaacaggcagagcagccacaccagcgtgcaggaggacaagacgggcggcaacgtgaaaaccagtgagcaggtcaccacgggggagcagcctgcccaggtgtgcatgcctttgtgagaat

SEQ ID NO: 72175 - DNA, 429 bp, Homo sapiens
cctacaatgtaacaaagtttcacagtattgtaggtacacatggaaaaatgcaatgaatattggctcatgcctgtagtctcagcctcccaaagtgctgggattataggtgtgagccaccgcgcccggccctccatgatgattttattttctaaatattttgtctggagatacatagcacgcagattacaggcatgagccccagtacccagccagtgggctggattctgaaatgcagaattcaaggacatcagtggaaaatctgtagaaaatggaataaattctgtagcttcgttaatagtgttacagcaatgctttttcttagttttgatgcagatgccctggggatgtgacatgtttactctgcatctgcactgcctttgcaataaataaaatgtggtctatcatgcaatggaatactattcagtcata

SEQ ID NO: 72176 - DNA, 228 bp, Homo sapiens
ttaatggatatttctgatattcttaactaaatttgaagctgtgagggaagacaaactcagggtccacagggtgggaaaagtccacaagatcaccctcaagtgccgtcattctctaggaccccgagagccctagcggttgttacgcttgcagttatgatttattacagtgcaaggctacagattaaaatcaaccaaggcaagagatgtatggggcctcttgggggccaa

SEQ ID NO: 72177 - DNA, 465 bp, Homo sapiens
ggctcacggctggagcccccatcctgccgttcggaccagtgcgggcctcggaggagtgtcccgcagcggacccccgcccaggaacccctgcaggcagcgagacgggcgcccgggccagctctctgcccctcgccccccgcggggaccctgcccgccccgctgaccggccccacgttgccaaatagctcaaatgcttgtcatatttgcggtcgcgcggctccgcgggctgtgcacgcgctgcactcgccgccgcctttgtcaccagccgcttcgtcattcgcctgagcacttctagagtgtgtagggggcgttactagtggcagtggtggtcctcgggccggagtgtctccttctgtctcccctcctctttcagcccgtccttacgagaaaatcaggggcgcgccggcccggcagggagctgggggcggcgctgccaccaggcgcccactgcgccccgccgcccct

SEQ ID NO: 72178 - DNA, 391 bp, Homo sapiens
tagaactatcaaacccatcaagctgcccccggagggtgagcctttcaaaaaatcttaaacaggtgcaggaccaggtgcactcaggattgtgagcaaatttctaggtgcagaacagtccagactctcagcccaaagttcaggccaggccagagcccacttgcctgcaggatgcacaagggagggtagggacaggtttagatgccaagtactcatcagagtttcaatttaaggacactcggaagccatgggaggctgtgaaccaaggatcacaatctgatttgctgtggtgggtaggacagcacaggagtggaggcacagagtagagtgaagattcctcaaagatcagacagtcacaagacatccatgagcgttctcatagctgtggcaatgt

SEQ ID NO: 72179 - DNA, 429 bp, Homo sapiens
  misc_feature (25)..(25): n is a, c, g, or t
ggtggcgggcactgaggcaggagantggcgtgaacctgggaggtggagcttgcagtgaccccagattgcgccactgcactgcagcctggagactccgtctcaaaaaaaaaaaaaaatttcaatagttaaaaatggatgctgagtttaaaaaaaaaaaaaaaaggttgagttgagagaataaggagaatcgcttgaacccagtgagccgagatcccaccactgcactccagcctgggcaacagaacaagactttctcaaaaaagaaagaaagaaaaaatgatagaatatgttcatgactagagggtaggcaaaggtttttaagaacctgaaaacaataaccataggggaaaagaattgccaattagagttaagttataactctcacgcattgttgatgagggtataaagcggtgtaaatgctttgggaga

SEQ ID NO: 72180 - DNA, 561 bp, Homo sapiens
ttatgtaatatgcataacgataataatcataatggttatgatgttctttctgtaaaaattcaaatatgccaaaaatatggcctattgatatctttaaagagacattctttaaaatataaaagattgagctgggcacggtggctcacacctgtaatcccagcactttgggaggctgaggtgggcagatcacgaggtcaggagttcgagaccaccctggccaatatggtgaaatcccacctttactaaaactacaaaaattagccgggcacggtggtacacgcctgtaatctcagctgcttgggaggctgaggcaggagaatcgcttgaacccagtgagccgagatcccaccactgcactccagcctgggcaacagaacaagactttctcaaaaaagaaagaaagaaaaaatgatagaatatgttcatgactagagggtaggcaaaggtttttaagaacctgaaaacaataaccataggggaaaagaattgccaattagagttaagttataactctcacgcattgttgatgagggtataaagcggtgtaaatgctttgggaga

SEQ ID NO: 72181 - DNA, 547 bp, Homo sapiens
gtgataggaaccacaagccccaagcagcctctggaagctggaaaaagcaaagaaacagattctttccagagtgtccagaaaggaatgcagttcagctaacatcttgattttagatcagtgagatttttgtgttggacttctacagaactatataagaataaattgtgttgcttaagcacactataatacatgtggcaagaagctgccagctaagccttgaagaatagtgaacaaactcttactggaggatgggaaggcagtaaataaattattgaattattgaaataaatggaggattgagttatgcattgacagaatgcttagcaataattttgcttgtcttaatgtggaacagaaaatgaaacttaatagcttgtagatgtcttaaggagatttccaggtgaatgttgaaagtactgatgaacttattatggctgcatctcataatgtacaggaagacatttactgagtgaactaaagaaggaactgttcaatttgaaagcagaatttagaggaaatttttcaacctagtacttgtcattttttt

SEQ ID NO: 72182 - DNA, 460 bp, Homo sapiens
acacatagaaggtacccaaaaactacaatccattcaacattattcacccaatgcatgtcagtgcccagcactgtcccaggagccagagacagggcgggattgaatgtcatcagggacaccatccacattgagttcctggaggcgccattaacagaatacagtgtgcagccagcagacctggcggtgtattggcaaatgcaatagatgaagtgcctgtcctcctggaggttataggctagcatgaaacagagagaaccaggaaaaccacgagatattgttgggcaggtcattgaaggaatacctaagatcatttcagatagtgagaagtgctctgtaaaaaacaacacagaggctgggcgcggtggctcatgcctttaatcccagcagtccacctgcctcggcctcccaaggtgctgagattacaggcttgagccaccacacccagcccatcagtacaatt

SEQ ID NO: 72183 - DNA, 1410 bp, Homo sapiens
ttatcctgggtgagatgacttcatctggtgaagggactgagcttttccagaagcctgtggaaatgtgggaagaatgtgatgctagggagattatcaattgctggctctgaagatggagaggatctgggagcacccccagctggcagccagaaagagggcagaggcttcagccctgcagctgcaagaacctgaactctgccagtggtgtgagcttccaggaggatccccagcttcggatgagactgcagcccagccaacacctcgatttctgccccgtgatgccctgagcagagaatccagcaaggtcatcccagacttctgacctgtagacctgtgagctaagaactgtgtgttgtttcaagtcactaagttggtgataatttgttactttgcaataggaaaccagcagtacactatctgctagacatacattgccttggtttctccccttccaagtcggccttgactaaccatcacccatgacagctctcatattcccatgcacaatcaattattattcctttgcattactacagtgaaagccattttggatctcttttaatgtttcttacaaattttttctttgatattttgttttttcttcattttcataataccttgtttcctgggactataaactctcgtacctgacctgattacctatctcatcaattaatcatcagttttcttagtgacaataaaattattgatagtctttattatgacccctgagacattacaaaagcttaaaggttacatttttaatgtgtgagattagctttgtgagctctactgtactttgattattcgagaactggtcatctcagtatgatatatatagaaaactttcctaaactgaatcagagtaagatgttaggtggactatatgcgattataatttcttgcaggagaatgtcctagaagccttagacaagctcagggtaacactatgtgggattttgaggaagacaacgacataagaaaagacaaatgtttctgaaaacatttttatttttttttctgcaagagaggtgaggacttggtgtcccatttacagtcagtgaagttggttgcaggagagagggtttagcttaagtacatccagcagccactgatggatgtcacattgctgctctggtctccttagcaccacgttcttcccagctctgtggcttgtgtccaagcagtccaggagataatccctgaaatttggaacttgtgcttattttggagctatgcagacagcaaaaaccttgagtcctcccatgtagtaatacatggaatctgagtttgggtgataagattggcgaaggagttcaatggtggggaaatggaaaggctaccaaataatcactctcctacccaaatgaatgggattactaataagtcgtaagtgcttgccccaacaga

SEQ ID NO: 72184 - DNA, 712 bp, Homo sapiens
agtctcagatgactatcatttgtattgatgatctctaaaatggcaccatctcatgactccagggttctcatcattcatgtgcaaagtacactaccagataatgtatcccataggtatggaacagaaaggctcatggaaaattaaaacaaatataaaacacatagaaaccaggggaaagaaacaggataagataatacacttaggatgaggcacaagcaacttggaagaactacatcacctgaatcctaagtccacagcatggatctctcgctctcgctctctctctcccctctctttccttccctcctcttctctctctctctctttccttctctttctccctttttcttttcctctctcttcctctatttctccttctgtgaggattttgcccttgtaatttgttccttaaaatattgagccccactaacgcagataaatggtgagagatagttgggacaaaaaaagacttaaaggtcaagctgaggaacatgaacctatatcctatatgtacctccctgtaagcacccaggattggagatgaaccttagatacaaaatacattattttagtgagttttggaatgtgaggaaaatctacttagaaaggataatttttaaaaatatacttaattatcttttaccataagcaagaaaataataaaatatgtgatgacataatatgaagaaaatgttatttgaaaaaaaaggaa

SEQ ID NO: 72185 - DNA, 1426 bp, Homo sapiens
atacttttgaaggatgtgcaacgttcaatgataagtgtgacaaaaactgacaaccaggaagcttgtgtactcagtgagagtagcatgtttgtctccaagaaacgtttcattttgaagacacgtggtaccactctcttactgaaagcgctggttcccctgttgaagcttgctaggcattacagtgggtttgactcaattcaaagcttcttttattcttgtgagaatttcatgaagccttccccctaagggtacctacactagaatttccaggaagaaatagagtttcttaatgcaattttcccaaatggagcagcatattgtatgggaagtatgaattctgactgttggtacttacgtactctggatttcccagaaaggtaatcagtcagccagatcaaaccctggaaaatttgatgagtgggcttgacccagcagttatggaccagttctacatgaaagatggcgttactgcaaaggatgtcatttgtgagagtggaattcacaacctgataccaggttctgtcattaatgccacaatgttcaatccttatgggtattcgatgaatggaatgaaatcagatggaacttattggactattcacatcactccagaaccagaatctttttatgttagctttgaaacaaacttaagccacctcctatgatgacctgatcaggaaagctatggaaggcttcaagccaggaaaatttgtgatcactttgttaatcagagttctaaatgtcgcgccgtgttttcttcacctcagaagattgaaggttttaagcgtcttgattgccagagtgctatgttcaatgattacaattttgtttttaccagttttgctaagaagcagcaataacagcagagttgattaagaaaaatgaagaaaaaaatgcaaaaagagaacacacgtaagaaggtggtggatgctttctagatgtcgatgctggggtcagtgctttccataaccaccacagtgtagttgcataaagccctatatgtaatgatagtgtaatcattttgaattgtatgcattattatatcaaggaaatagatatcttgcacgaatgttcgcttctgtgtttaggtattctctgccactcttgctgtgaaattgaagtgcatgtagaaaaaaccttttactatatgaaactttataacacttgtgaaagcaattcaatttggtttatgcacagtgtaatatttctccaagtatcatccaaaattccccacagacaaagctttcatcctcattaggtgttggactcagcctaaccgtctaggactgttctattaaattgctgccagaattttacatccagttacctccactttctagaacatattctttactaatattattgaaaccaatttctacctcatacagaggttttttaaaacagcaattaaagtttttcttccatg

SEQ ID NO: 72186 - DNA, 326 bp, Homo sapiens
attagcatgagaaaaaaagaatgtgagtcaggattcagtactgaaaagttcaaattatggaattttttaagagaaagaaacatttactactttctgtaacttgaactaacctctggtttaaagtggaattccttcagctacatgacataatggaaagtagattgtcaagaaatagtgggaactggattctggctgtggttcttctcattaccagctggataagcttggacaaaccccttgaactttctgaatctcaagttcatcatctattaaatggcaaaaataataactgctaatatttatggagtatttactaccattttaca

SEQ ID NO: 72187 - DNA, 547 bp, Homo sapiens
tgaccacagatgttgcctgaatctcactttctggaacagtagcatatgaccatatataaagcccccaaccaacactttccctaatggactattccctgctcattcctgacagaggtgtccgcactgtttctggggttcctttcattatacagactctcaaaaccaaacaggttatttggtaaatggaagagatctattacagtgtggagtcattaaaacagtccttcccagtatccagctcccttccgctttgcctgcttgactttctagagagcccacctcctctttcgagtcagtagagagtcactgagttcaatttgctgcaaactaattaattcctaagaactttgacactagaagctaagaccccaaaacagctcctcctcctttcatcctgagagaaaatatttcagatataatacatacattttcaatttccatatttaaaattcgcttcaatccatttttccccatatttataaggtcacatttgttctttatgttaatggcacagatttcagagccaggagactcaaagtacttctca

SEQ ID NO: 72188 - DNA, 525 bp, Homo sapiens
accttgtgattcacccacctcggcctcccaaagtgctgagattacaggagtgagccactacaccaggtcatttcttagtatttttactcttttgatctatagtaagtaaaattgtttttatctttgaatttttaaatttttaacacagttcaaatcagtgtgtctgatttcatctccttctctaacaaaccagggtgccagaactgcttcagtttctctgccttctctttgtctatgatgactaatgtatgaaggtatctgctgcatcaaactttaaacttcacattatccttatttctcttgaccttgacagatctggcatcttttcacctggctgtaagcagaaagtccttgatctccttaactttttgaggcatggcagcatgtgaggcagggagaggacacagacccacacagcaagtggtgagaagccaacagtggaattgttttcttaattccatttgttgattgtttattgctagtgtatagaaatacaactgatttttgtatattgatcttgtattc

SEQ ID NO: 72189 - DNA, 363 bp, Homo sapiens
ggatttttattaaaatttctgtttgtatattaatttcagggaaaacaatattcttctatatgagcctttcctttcagtaatctgcatttattcaagtgtcctcatatatgttttccaaaaattttatcattttcattatataggtcatgtatcttataggaggcagaattctaaagtccctctaagttttccacccctagtcagtaaaacactaatctaggcactgctaagaatgtacagatgtaattaaatttatagatcttaaagtagggaaattattgtagatatctggttggcccagtctaaccaattgagccctcataaaaagagaaatttcttcagctggagtcagtcagatgtggc

SEQ ID NO: 72190 - DNA, 3888 bp, Homo sapiens
ccgagtgacaaggaggtgggagagggtagcagcatgggctacgcggttggctgccctcagtccccctgctgctgaagctgccctgcccatgcccacccaggccgtggggccaggggcctgccagggctaggagtgggcctgccgttcatgggtctctagggatttccgagatgcctgggaagagaggcttgggctggtggtgggcccggctgcccctttgcctgctcctcagcctttacggcccctggatgccttcctccctgggaaagcccaaaggccaccctcacatgaattccatccgcatagatggggacatcacactgggaggcctgttcccggtgcatggccggggctcagagggcaagccctgtggagaacttaagaaggaaaagggcatccaccggctggaggccatgctgttcgccctggatcgcatcaacaacgacccggacctgctgcctaacatcacgctgggcgcccgcattctggacacctgctccagggacacccatgccctcgagcagtcgctgacctttgtgcaggcgctcatcgagaaggatggcacagaggtccgctgtggcagtggcggcccacccatcatcaccaagcctgaacgtgtggtgggtgtcatcggtgcttcagggagctcggtctccatcatggtggccaacatccttcgcctcttcaagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagagaaaaaaggaaaaaaaatcaaaacacaaaaaagccaaaacgaaaacaaatctcgagtgtgttgccaagtgctgcgtcctcctggtggcctctgtgtgtgtccctgtggcccgcagcctgcccgcctgccccgcccatctgccgtgtgtcttgcccgcctgccccgcccgtctgccgtctgtcttgcccgcctgcccgcctgcccctcctgccgaccacacggagttcagtgcctgggtgtttggtgatggttattgacgacaatgtgtagcgcatgattgtttttataccaagaacatttctaataaaaataaacacatggttttgcaaaaaaaatc

SEQ ID NO: 72191 - DNA, 500 bp, Homo sapiens
ggtcttgaactcctgacctcaagtgatccacccacctcagtctcccaaagtgctgggattacaggtgtgagccaccatgcccagttagtttcttcatctctacaatggaggtgattacaccttagcattgttgtgagaaatcaatgagtgaatatacatcaagagttccgtacaatgcctgacacatagcaagtactggtggaagttacttacttaatgttattgttgttattcaatatgttatctaatatcatgattacccaggctgtggcccgcagcctgcccgcctgccccgcccatctgccgtgtgtcttgcccgcctgccccgcccgtctgccgtctgtcttgcccgcctgcccgcctgcccctcctgccgaccacacggagttcagtgcctgggtgtttggtgatggttattgacgacaatgtgtagcgcatgattgtttttataccaagaacatttctaataaaaataaacacatggttttgcaaaaaaaatc

SEQ ID NO: 72192 - DNA, 441 bp, Homo sapiens
catcacccactcccactcagggtgtggggagcagctctctgaaggacctggaattttggcacagagggcggtgaatgaagagggagctgtgggcagaaggcagcatgtgcagaggggtgagggcggcggttgtgtgatggtggatgcgtgtgagaatgggcaaggaatgtgggggtggatgagccaggaaggcatgcgtctcaggggaccggggctgggcagaggtggttgtggggcctgagtcagacgtggggcgggtgtggatctggaggggagaggtgtggtcttgcccgcctgcccgcctgcccctcctgccgaccacacggagttcagtgcctgggtgtttggtgatggttattgacgacaatgtgtagcgcatgattgtttttataccaagaacatttctaataaaaataaacacatggttttgcaaaaaaaatc

SEQ ID NO: 72193 - DNA, 3831 bp, Homo sapiens
ccgagtgacaaggaggtgggagagggtagcagcatgggctacgcggttggctgccctcagtccccctgctgctgaagctgccctgcccatgcccacccaggccgtggggccaggggcctgccagggctaggagtgggcctgccgttcatgggtctctagggatttccgagatgcctgggaagagaggcttgggctggtggtgggcccggctgcccctttgcctgctcctcagcctttacggcccctggatgccttcctccctgggaaagcccaaaggccaccctcacatgaattccatccgcatagatggggacatcacactgggaggcctgttcccggtgcatggccggggctcagagggcaagccctgtggagaacttaagaaggaaaagggcatccaccggctggaggccatgctgttcgccctggatcgcatcaacaacgacccggacctgctgcctaacatcacgctgggcgcccgcattctggacacctgctccagggacacccatgccctcgagcagtcgctgacctttgtgcaggcgctcatcgagaaggatggcacagaggtccgctgtggcagtggcggcccacccatcatcaccaagcctgaacgtgtggtgggtgtcatcggtgcttcagggagctcggtctccatcatggtggccaacatccttcgcctcttcaagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagagaaaaaaggaaaaaaaatcaaaacacaaaaaagccaaaacgaaaacaaatctcgagtgtgttgccaagtgctgcgtcctcctggtggcctctgtgtgtgtccgccccgcccgtctgccgtctgtcttgcccgcctgcccgcctgcccctcctgccgaccacacggagttcagtgcctgggtgtttggtgatggttattgacgacaatgtgtagcgcatgattgtttttataccaagaacatttctaataaaaataaacacatggttttgcaaaaaaaatc

SEQ ID NO: 72194 - DNA, 2970 bp, Homo sapiens
tgggacagttgtggaccctgggcttctgggggtgagggacgtgggcccaaagcaagtgtggccaggagtgggggcagtttcgtggacagacgcggctgggctgggctggtgtatgttcctacaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagagaaaaaaggaaaaaaaatcaaaacacaaaaaagccaaaacgaaaacaaatctcgagtgtgttgccaagtgctgcgtcctcctggtggcctctgtgtgtgtccctgtggcccgcagcctgcccgcctgccccgcccatctgccgtgtgtcttgcccgcctgccccgcccgtctgccgtctgtcttgcccgcctgcccgcctgcccctcctgccgaccacacggagttcagtgcctgggtgtttggtgatggttattgacgacaatgtgtagcgcatgattgtttttataccaagaacatttctaataaaaataaacacatggttttgcaaaaaaaatc

SEQ ID NO: 72195 - DNA, 3747 bp, Homo sapiens
ccgagtgacaaggaggtgggagagggtagcagcatgggctacgcggttggctgccctcagtccccctgctgctgaagctgccctgcccatgcccacccaggccgtggggccaggggcctgccagggctaggagtgggcctgccgttcatgggtctctagggatttccgagatgcctgggaagagaggcttgggctggtggtgggcccggctgcccctttgcctgctcctcagcctttacggcccctggatgccttcctccctgggaaagcccaaaggccaccctcacatgaattccatccgcatagatggggacatcacactgggaggcctgttcccggtgcatggccggggctcagagggcaagccctgtggagaacttaagaaggaaaagggcatccaccggctggaggccatgctgttcgccctggatcgcatcaacaacgacccggacctgctgcctaacatcacgctgggcgcccgcattctggacacctgctccagggacacccatgccctcgagcagtcgctgacctttgtgcaggcgctcatcgagaaggatggcacagaggtccgctgtggcagtggcggcccacccatcatcaccaagcctgaacgtgtggtgggtgtcatcggtgcttcagggagctcggtctccatcatggtggccaacatccttcgcctcttcaagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgagaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagagaaaaaaggaaaaaaaatcaaaacacaaaaaagccaaaacgaaaacaaatctcgagtgtgttgccaagtgctgcgtcctcctggtggcctctgtgtgtgtccctgtggcccgcagcctgcccgcctgccccgcccatctgccgtgtgtcttgcccgcctgccccgcccgtctgccgtctgtcttgcccgcctgcccgcctgcccctcctgccgaccacacggagttcagtgcctgggtgtttggtgatggttattgacgacaatgtgtagcgcatgattgtttttataccaagaacatttctaataaaaataaacacatggttttgcaaaaaaaatc

SEQ ID NO: 72196 - DNA, 3141 bp, Homo sapiens
  misc_feature (672)..(672): n is a, c, g, or t
  misc_feature (785)..(785): n is a, c, g, or t
  misc_feature (1273)..(1273): n is a, c, g, or t
  misc_feature (2464)..(2464): n is a, c, g, or t
ctagcatcagtaggtttaccatagaaggattcagtggagatagcgagggtggtgagtgttgctggattgagcccgtccctgcagcctgggcacgggagcactgcagtgccatgaaggagagggctgggggataatagcacagccggttcctatttccttttccacctggttaagactcccggggaggccctgcccagcagtccttatgagatgctgccttcctcttttttgaaaggcatagatgataaggaggtggacatgttttgagaagagaacctagagctcattacttgtatttgaggcatgtattgcttcactcccactttgggagagttttttctggggaagttaaaggctattcaggatcagagagtttcctgcatggtcccaggggctgggaggagccacctgctcagctggtggttagctgatagcacccagcctacccaccaagataggaggcagctcagatgtcactgggattcgcagtaccacaggctgtccctgggcccaagcagttagctagctgcaccccgggagggggtgttgagagcactgaagctcctgtgggagagtgcctttgacatccccccactccccactgcccagaactaggaggtagtgaaaggtgtcagtggcaagaaggctgggccagagcatggagggaggccnacctgggctccacacccacctcctccaccaccggctggctgtgcgaccctgggcaggtggcgggggttaagcctcagtgtccttctttgaaaaggggcatcatcctatcctcngtttgaggattagacgtgatagtgcgcaggaagcactctggtgcctggtacattgtaagtgctcaataaatgcagcttcccaaaatgatttcaatggcacatggtcctgcatccaggtgggatctgctacttgagtctccccctcaaaggggcctgctgaaatacgcagctcagtgggaaaccaaaacatacacccctttcctccagtgctccccaggaagcgccaagtcctgagcccagccagcaacttcgaagaagtgccctccaacaagtggcagtgggcacttgagcaagtgacttaacgcagccctctccccagcccctgcatccatctgggcctcattatctgggaggtggcttcttgtttcagagttacaggccctgaacaattttgtgttgggatgtgccataggcagtgccaggaaggttctttcatgagtaatttaacttgttactaagtttgctatcagccggggggctctttcccngggttcccttctttccctgggtccccttccccgcaaagcaaagtccaactcaagttagaaacatcccacagcctggagtcaggctgccctctcttcagttggtgtgtgatgtagaagcaggaagggcttcccactgataaccctaaaaataactgcccagaaatgctgtcagatggggccaagaggtgcacaggagcctgtgcccagctgccgacctggaacgtgggactttctagagggcttggaggagccctgccccttccaggcctcttcccaacagtgcttctcacgcctgctgctccattcccttttcctccttcctcccgcgcccccccctttcctggggtcacttcctgatgccattcttcaacttcgcccctgtcccccccaaaagcaatcaaatccacaacctaataaggcaaaagaatgaggagaatgtccgcctcccagcctctcccctaacagggtgcaggcctgaagcaaatttggaaaatgttacaacggagtgacaaccgatgggggctgggggtggggcggtgcagccttgttcaggagctgcccattgttggcctgaggcaggaccctaagggaaggccacccggtttgcgctttcctgatcaggctgttgacacccttctagcacaagaaaatgtatggaaagtaactgcctgagtcagctgcatctccagttgtgggatccacgtgccaggagaacacgaagtacacacaggtccgcagtgggagcccgctcggagacacctccccgccatcacggctgggactgtgcatatccaaacacttcttgcctctgagatgagcagttttcttccccttgactgtgccagggttcaattagcctgggcattaattaaaacttgtcaacacttagagtggggcccccagaaatctgtcacccctcctagatcattatcccaggctaatcaaccctctctaaggcagtttccattcttgacttagtgggagggaggaacaagcccctcggtgctggggagctctgggggaggtagggactgactgggcccaacccactttgttttggaaggtcaagcttagtaattaacctgaatgcttgggggagggggtgaaggagaaagaactgagtctagggatgtgccaggtctttcaaattgctaattatcagcgagcatgaggtcatccgtaaatatatcnaattctttagcttgtaattaaggtgctcattaaaagtgcagggaagtcttgttttcctaaaaggggaaaaaaacaacaacacaaaaagtctttgttttgacctgacacgatggctcagaacagggggaggactcaaggcacaggactagtttcctgccttaaagagcctttacaggaaattgactgcaaacagtattggtgaccctgccaaggaggcaaacctagggtgatgtcattgttcgaagctgtcaccgccaagcctctggccttggggcgaggagagttggtgggattaaaaaatgagtgtgtgtatgtgtgtgtgtgtttagcagtctctaaagaggcgagtcaagggaaaatcctagcgggagaaaaatcacaaggggtggggggtgtctcagaaatattcttagctgggttcaactttcctcgtttttctaagtttaaaaaatcctctcttactatttttgctcatcaaaatgctgctgctttttcagagacagccttttttgagccattccctatttagtgttttgggtaattggctgttacagtatggaatttgtggcccaaaggcagcgtggtaagttagacactaggtgcacggtgccccattgttatgaagtgtggaaactgagacgctggactagtctgatgtatctgtttcttccaccaaa

SEQ ID NO: 72197 - DNA, 919 bp, Homo sapiens
atttgtcttccatttgaagataccagggaaaagtcttgtcaagtagcaggccaccggtgtctagtgtagaggagacgatttctgtcgatagagagcaaagccagccaggcaaacgaacccgtaagccgcctgagggacagacaggcataaaacctaatgaatgggtaggtagactttgggcaaggctaattgcagcaagctgtgttcagttccccggcctctgttaagtagtcatttttatacaatctgtcggagggaagaggaaatagacccacacggtaaatgaacttgtggtgtttagctaggaagtggagtttgctctaagtagctctggtagcagactccagggagcacatggcaggcggactcatctgagtatctgtgctgaggagttgtgttaaactgttgaaacacttagaaattgctatagaaaaagagtactcccaaagttgccagctaatatggtaccgaatttcctgaaagacctttcttttgccatgtggtttttctataaagctgagtcaattaggcttctttatctccctgtccttggcaataaaacgacaaaagccgagggttgaacaggtagacactgttatctcactgaatcttcaccgctgccctatgaggtggctattgttactctccccattctatagatgaggacactgagccacagattggttgagtaacttgctcaggctcacacaactagcaggtgataacagctgaggtgaaagaacattttttctgggaagatacagggtgtttaaaggtacctgtttagtgcacagcaagttgcagtacttttaaattggagactggaatatgtaagtagatgtttgaatctctctctgtctttcagtgttacaggtgaatcaacaaaattagaatatctttctatttagtgactgaagaa

SEQ ID NO: 72198 - DNA, 384 bp, Homo sapiens
atagtgtcacttgagatataaattgttaaattttgatgaagtccaatttatctgtttattttttcttttgtcatacctaagaaactattgcctatatttggccaggtgcagtggctcacacctgtaatctcagcactttgcgagaccgagacaggcagattatctgaggttaggagtttgaggccagcctggccaatatggtgaaactccatctctacaaaaatacaaaaattagccaggtgtggtggggcacccctgtagtcccagctgggggggtggtggggtggccctgaggtgggaggatcgcttgaacttgggaggcggaggtttcagtgagctgagattgtaccactgcgctccagcctggtcgtgagactccgtctc

SEQ ID NO: 72199 - DNA, 373 bp, Homo sapiens
atatggaaaattctaaacatgatttgaactactcaagaagactattaaagagagttcctaaattgtacagaccgaaaccgaaagaagctgagagataatccttccagatcctttgtcaacattgactctagtgccccccaaccctccatctaaaggactgacattcatcaacctcttcatgagcaggggtattacataaaattgggagaatgaactctaacatttcatagtaaatttatctcactgaaatggaaagcagcagtgtatgtaaagggtttttaaaaaataaaacaacatcctataatcttccaattaatatcttcattccagaccttccagaattttaaaacacacccgctccattttgttttta

SEQ ID NO: 72200 - DNA, 585 bp, Homo sapiens
ctgtgcctggccaaatgctttcgtttctttaaaaatcaaagggaaaggaatgactataatccagtctgcattgtatatgtccttataccagtacatttgtgggatataatttttagttctttttatggagaagaagttcccaaggcagatgtgtctggggctcgtgaaaattcatcctgaagtcctccatgtccgggatgtatttcactgctaggaatccctcctgggcagaggtaggatctaaaggtgtgaccgctgaggaagtaggtcggctctctttttgtttgttttttgtttttgttttcagatggagtctgtctctgtcgcctgggctggagtgtagtcgtgtgatctcagctcactgcaacctccacctcctgggttcaagtgattctgctgcctcagcctccacagtagctgggatcacaggcacgcgccaccacacccagctaatttttgtgtttttagtagagatggggtttcaccatgttgtccaggctggtctcaaagtcctgacctcaagcgatccacccacctcagcctcccaaagtgctgggattacaggggtgagccaccgtgcccagc

SEQ ID NO: 72201 - DNA, 368 bp, Homo sapiens
tagacccaactctcttattttgacaatttgacatgaccttatgacacaggtttggagaggcaaaattttctacttgtggtattgaagtctggaatacattatctttattatttctctttgacacatgtgcagtgtattatagagaaaagctagttggaaccagaaaatttgagcttgagtttcatttagccatttattcgctgtcctgtgaaacagtgcttgtcctctctcacccttagtttgttttacttagaaatagaggctaattatagcttgtattaaataagcaatccccaactttgcaatgtatatcagaaaactcagctgaaaactataacttgagtggtcatgtagttataatgggttta

SEQ ID NO: 72202 - DNA, 4561 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaacccagaagattagccagctggctgcggtgaaccgggaaagcaagttccgcgtggtcatccagcctgaagccctcttcagcatctactccaaggccgtgtccctggaggtggggctgcagcacttcctcagctttctgagctccatgcgccgccctatcttggcctgctacaagctgtgggggcctggcctcccaaacttcttccgggccctggaggacattaacaggctgtgggaattccaggaggccatctcgggcttcctggctgccctgcctctcatccgggagcgtgtgcccggggccagcagcttcaaactcaagaacctggcccagacctacctggcgagaaacatgagcgagcgcagcgccatggctgccgtgctggccatgcgtgacctgtgccgcctcctcgaggtctccccgggcccccagctggcccagcatgtctaccccttcagtagcctgcagtgctttgcctccctgcagcccctggtgcaggcagctgtgctgccccgggctgaggcccgcctcctggccctacacaacgtgagcttcatggagctgctgagtgcacaccgccgtgaccggcaggggggcctgaagaagtacagccgctatctaagcctgcagaccaccacgttgccccctgcccagcctgctttcaacctgcaggctctgggcacctactttgaaggcctgttggagggtccggcgctggcacgggcagaaggagtctccaccccacttgctggccgtggcttggcagagagggcctcccagcagagctgagaggagggggtgaccagcttggagtctctggtgggcagagagggatggggtccctgagccaggccccacccatcacagcattcccaggtcctggtacccagccctcagttgtcatttggttcagaatcagttccctttctctgggaccaaatttcccttctctaaacatcctacagagaaggttccaaagctgagcacccatcaccctaggtgtgcaccagactcctattagcccctccttccaggagctagaaccagggaggtcctgagtgaggaaggcatgacctctgggctctctaggtggccctggtcttgccccatccatcccacctgccactaccttgggtgtccttacagctctgccctgaccccagcccctgcccctggacacctgctgacagctcccacacagaacagtctgaggtgatgctggctacagccctggcagcccatggcaactcaaagtgccttccaaaccaaactgcccctcatgaggttagggtcccccaccctccacctgcccagaggccaactctgttcccttctcctttcatcccagaggggcctcatcagcaaagacagaaactgatgttccatgcatgtccctgcttccaaagcctgaccttccaaagcttgcttccttcctcctggctgcacagacacctctgcttggccacagctttgctctttggtcctcaggccaccagacccctcacagcatggcccttggctcttcctgcactgccctcaccctcagccgtcccaaggagtgcccagcactactcagcatgtagtccaggacctgcggcatcagcatcccctgggagcttcttagaaatgcagacctgtgggctctaccacaggcctctggaatcagaatcttcagggtggggcccagcagtctgtgttttaacaggttctcccggtgatgctggtgcatgctcaagtttgagaaccgctgctctcatagactgctcctccaaggggaagcagtgtggaacagcagagaaagtcccgtccctatctctgactgtgcagtgagtgtggcctaggaacaggtcccttcctaagctctagtgtccccatctgtaaaatgggctgattggcctccacggtcagagcggccatctggctgtgccatcctgcatttttaggaatggaaagcaggcctctgaggcagtggacaggaagacttctcatccttgaattctagctcccattccaaactgttagtccccaaccttgtggtcacatcagaggtcaacagcagaacagaggcaggtcagggttgtccgctctgattagcagaacgacagccccttcctcctcctccctccttcccatccctactcattagctccctgctcctgggatgcttcccaagcagcccaggcctctagcctccatggctgatgacctcagctttcacactggtgaagtctgtgtacccatactgcagccccatcccatggggcccctgaagacccactgaggaattccgtagggtcttgttcccacgaccggagtgctggctctcacagtgaattttgatgcatttaaaataagattctgatgccagactgttaaaataggcgctggttctgaagcaccgatggaaacagattgatgcagatggaaggaggaagggagactgggcccactgatttccagccccaccatgtgtgctgttttcagatgtgattgaggggtgttctgccctgcctccactgtcacagcctttaataaagatgtgaatcttgaaaaaaaaaaa

SEQ ID NO: 72203 - DNA, 3582 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaggcagagcccagactcttggagcagttgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcacccttgcgaacccttattccacgaccatcgcgttctccgatggatccagctcctccctgcaggctgttctctcttccctatgctggaactcagttctcctctggggataccatgtcccctcttcctcccacactcatgggcatcagaggtgggaggtagggtcaaggccccctgcttcctggactgttccagccccttcctggccgtctggtaagatcctctgtccctctcagggtgggccccatgctccccagctcatcccagacacccacctgcccaccctcattgagggcagacgtgagcattcacctcccagatttcttctccctgctcaggtcctgccttcctcctgagtgacttctatttccacccacctgcccgccactccttaacctctcaggggttgtcaccccattcccccagacagctgcctgccccgtggccgtgccctgcaccttgccatcaccgagcactgttggtccctcagccggtcctctcagactctgac

SEQ ID NO: 72204 - DNA, 4207 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcggtgagtggcccagaagttcagcccaggactcctgcctccccccatttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagccctgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggagcccatggagaccgccgagccacatcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaggcagagcccagactcttggagcagttgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcacccttgcgaacccttattccacgaccatcgcgttctccgatggatccagctcctccctgcaggctgttctctcttccctatgctggaactcagttctcctctggggataccatgtcccctcttcctcccacactcatgggcatcagaggtgggaggtagggtcaaggccccctgcttcctggactgttccagccccttcctggccgtctggtaagatcctctgtccctctcagggtgggccccatgctccccagctcatcccagacacccacctgcccaccctcattgagggcagacgtgagcattcacctcccagatttcttctccctgctcaggtcctgccttcctcctgagtgacttctatttccacccacctgcccgccactccttaacctctcaggggttgtcaccccattcccccagacagctgcctgccccgtggccgtgccctgcaccttgccatcaccgagcactgttggtccctcagccggtcctctcagactctgac

SEQ ID NO: 72205 - DNA, 3438 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaggcagagcccagactcttggagcagttgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcacccttgcgaacccttattccacgaccatcgcgttctccgatggatccagctcctccctgcaggctgttctctcttccctatgctggaactcagttctcctctggggataccatgtcccctcttcctcccacactcatgggcatcagaggtgggaggtagggtcaaggccccctgcttcctggactgttccagccccttcctggccgtctggtaagatcctctgtccctctcagggtgggccccatgctccccagctcatcccagacacccacctgcccaccctcattgagggcagacgtgagcattcacctcccagatttcttctccctgctcaggtcctgccttcctcctgagtgacttctatttccacccacctgcccgccactccttaacctctcaggggttgtcaccccattcccccagacagctgcctgccccgtggccgtgccctgcaccttgccatcaccgagcactgttggtccctcagccggtcctctcagactctgac

SEQ ID NO: 72206 - DNA, 2057 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgcctta

SEQ ID NO: 72207 - DNA, 2291 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcacccttgcgaacccttattccacgaccatcgcgttctccgatggatccagctcctccctgcaggctgttctctcttccctatgctggaactcagttctcctctggggataccatgtcccctcttcctcccacactcatgggcatcagaggtgggaggtagggtcaaggccccctgcttcctggactgttccagccccttcctggccgtctggtaagatcctctgtccctctcagggtgggccccatgctccccagctcatcccagacacccacctgcccaccctcattgagggcagacgtgagcattcacctcccagatttcttctccctgctcaggtcctgccttcctcctgagtgacttctatttccacccacctgcccgccactccttaacctctcaggggttgtcaccccattcccccagacagctgcctgccccgtggccgtgccctgcaccttgccatcaccgagcactgttggtccctcagccggtcctctcagactctgac

SEQ ID NO: 72208 - DNA, 2245 bp, Homo sapiens
gcccatctaggagtggcatcttttttggtgccctgaaggccagctctggaccttcccaggaaaagtgccagctcacagaactgcttgaccaaaggaccggctcttgagacatcccccaacccacctggcccccagctagggtgggggtccaggagactgagattagcctgccctctttggacagcagctccaggacagggcgggtgggctgaccacccaaaccccatctgggcccaggccccatgccccgaggaggggtggtctgaagcccaccagagccccctgccagactgtctgcctcccttctgactgtggccgcttggcatggccagcaacagcagctcctgcccgacacctgggggcgggcacctcaatgggtacccggtgcctccctacgccttcttcttcccccctatgctgggtggactctccccgccaggcgctctgaccactctccagcaccagcttccagttagtggatatagcacaccatccccagccaatgcagctgtatccaagaaagccagcccagaggctgccagcactcccagggaccctattgacgttgacctggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaggcagagcccagactcttggagcagttgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctccaaaggaagatcctcaaatgtagagtatattttttctctttctaccatgacaggaagcaagaaagaagaaaaagcattctaaacaaaatggttttgtaaataagaaaccagagggaggagctgattttcagtgggacagagttccatctttaacaggttc

SEQ ID NO: 72209 - DNA, 324 bp, Homo sapiens
ctctgtgactccctctatgcaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctcctggtccgaggcgtagcacttcatcctctgcaccagcgcgctgcccgtgcggatgcgctgcagcacagcatccaggcggaccagccgactggccatctcctcgtagtcgcgctggtaccgcgcgctcacagcctccagcatctccgctttggaaggggt

SEQ ID NO: 72210 - DNA, 3622 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcggtctcttccagccctcagtctgaggttctgtattggaaagtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaggcagagcccagactcttggagcagttgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcacccttgcgaacccttattccacgaccatcgcgttctccgatggatccagctcctccctgcaggctgttctctcttccctatgctggaactcagttctcctctggggataccatgtcccctcttcctcccacactcatgggcatcagaggtgggaggtagggtcaaggccccctgcttcctggactgttccagccccttcctggccgtctggtaagatcctctgtccctctcagggtgggccccatgctccccagctcatcccagacacccacctgcccaccctcattgagggcagacgtgagcattcacctcccagatttcttctccctgctcaggtcctgccttcctcctgagtgacttctatttccacccacctgcccgccactccttaacctctcaggggttgtcaccccattcccccagacagctgcctgccccgtggccgtgccctgcaccttgccatcaccgagcactgttggtccctcagccggtcctctcagactctgac

SEQ ID NO: 72211 - DNA, 3820 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgaggaacgcgttgtggtgatcagcagctcggaagactcagatgccgaaaactcggtgagtggcccagaagttcagcccaggactcctgcctccccccatttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagccctgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaggcagagcccagactcttggagcagttgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcacccttgcgaacccttattccacgaccatcgcgttctccgatggatccagctcctccctgcaggctgttctctcttccctatgctggaactcagttctcctctggggataccatgtcccctcttcctcccacactcatgggcatcagaggtgggaggtagggtcaaggccccctgcttcctggactgttccagccccttcctggccgtctggtaagatcctctgtccctctcagggtgggccccatgctccccagctcatcccagacacccacctgcccaccctcattgagggcagacgtgagcattcacctcccagatttcttctccctgctcaggtcctgccttcctcctgagtgacttctatttccacccacctgcccgccactccttaacctctcaggggttgtcaccccattcccccagacagctgcctgccccgtggccgtgccctgcaccttgccatcaccgagcactgttggtccctcagccggtcctctcagactctgac

SEQ ID NO: 72212 - DNA, 3092 bp, Homo sapiens
tgacttcagaggatcccccgcgtggatcttgtgctggatcttgtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcggtgagtggcccagaagttcagcccaggactcctgcctccccccatttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagccctgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaggcagagcccagactcttggagcagttgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcacccttgcgaacccttattccacgaccatcgcgttctccgatggatccagctcctccctgcaggctgttctctcttccctatgctggaactcagttctcctctggggataccatgtcccctcttcctcccacactcatgggcatcagaggtgggaggtagggtcaaggccccctgcttcctggactgttccagccccttcctggccgtctggtaagatcctctgtccctctcagggtgggccccatgctccccagctcatcccagacacccacctgcccaccctcattgagggcagacgtgagcattcacctcccagatttcttctccctgctcaggtcctgccttcctcctgagtgacttctatttccacccacctgcccgccactccttaacctctcaggggttgtcaccccattcccccagacagctgcctgccccgtggccgtgccctgcaccttgccatcaccgagcactgttggtccctcagccggtcctctcagactctgac

SEQ ID NO: 72213 - DNA, 2792 bp, Homo sapiens
ttcagctggtctgcgctcccctgacgtgggctggggcacgtcaccgccgaatggcagcctccagaaagccaccgcgagtaagtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaacccagaagattagccagctggctgcggtgaaccgggaaagcaagttccgcgtggtcatccagcctgaagccctcttcagcatctactccaaggccgtgtccctggaggtggggctgcagcacttcctcagctttctgagctccatgcgccgccctatcttggcctgctacaagctgtgggggcctggcctcccaaacttcttccgggccctggaggacattaacaggctgtgggaattccaggaggccatctcgggcttcctggctgccctgcctctcatccgggagcgtgtgcccggggccagcagcttcaaactcaagaacctggcccagacctacctggcgagaaacatgagcgagcgcagcgccatggctgccgtgctggccatgcgtgacctgtgccgcctcctcgaggtctccccgggcccccagctggcccagcatgtctaccccttcagtagcctgcagtgctttgcctccctgcagcccctggtgcaggcagctgtgctgccccgggctgaggcccgcctcctggccctacacaacgtgagcttcatggagctgctgagtgcacaccgccgtgaccggcaggggggcctgaagaagtacagccgctatctaagcctgcagaccaccacgttgccccctgcccagcctgctttcaacctgcaggctctgggcacctactttgaaggcctgttggagggtccggcgctggcacgggcagaaggagtctccaccccacttgctggccgtggcttggcagagagggcctcccagcagagctgagaggagggggtgaccagcttggagtctctggtgggcagagagggatggggtccctgagccaggccccacccatcacagcattcccaggtcctggtacccagccctcagttgtcatttggttcagaatcagttccctttctctgggaccaaatttcccttctctaaacatcctacagagaaggttccaaagctgagcacccatcaccctaggtgtgcaccagactcctattagcccctccttccaggagctagaaccagggaggtcctgagtgaggaaggcatgacctctgggctctctaggtggccctggtcttgccccatccatcccacctgccactaccttgggtgtccttacagctctgccctgaccccagcccctgcccctggacacctgctgacagctcccacacagaacagtctgaggtgatgctggctacagccctggcagcccatggcaactcaaagtgccttccaaaccaaactgcccctcatgaggttagggtcccccaccctccacctgcccagaggccaactctgttcccttctcctttcatcccagaggggcctcatcagcaaagacagaaactgatgttccatgcatgtccctgcttccaaagcctgaccttccaaagcttgcttccttcctcctggctgcacagacacctctgcttggccacagctttgctctttggtcctcaggccaccagacccctcacagcatggcccttggctcttcctgcactgccctcaccctcagccgtcccaaggagtgcccagcactactcagcatgtagtccaggacctgcggcatcagcatcccctgggagcttcttagaaatgcagacctgtgggctctaccacaggcctctggaatcagaatcttcagggtggggcccagcagtctgtgttttaacaggttctcccggtgatgctggtgcatgctcaagtttgagaaccgctgctctcatagactgctcctccaaggggaagcagtgtggaacagcagagaaagtcccgtccctatctctgactgtgcagtgagtgtggcctaggaacaggtcccttcctaagctctagtgtccccatctgtaaaatgggctgattggcctccacggtcagagcggccatctggctgtgccatcctgcatttttaggaatggaaagcaggcctctgaggcagtggacaggaagacttctcatccttgaattctagctcccattccaaactgttagtccccaaccttgtggtcacatcagaggtcaacagcagaacagaggcaggtcagggttgtccgctctgattagcagaacgacagccccttcctcctcctccctccttcccatccctactcattagctccctgctcctgggatgcttcccaagcagcccaggcctctagcctccatggctgatgacctcagctttcacactggtgaagtctgtgtacccatactgcagccccatcccatggggcccctgaagacccactgaggaattccgtagggtcttgttcccacgaccggagtgctggctctcacagtgaattttgatgcatttaaaataagattctgatgccagactgttaaaataggcgctggttctgaagcaccgatggaaacagattgatgcagatggaaggaggaagggagactgggcccactgatttccagccccaccatgtgtgctgttttcagatgtgattgaggggtgttctgccctgcctccactgtcacagcctttaataaagatgtgaatcttgaaaaaaaaaaa

SEQ ID NO: 72214 - DNA, 3011 bp, Homo sapiens
ctcttggccttgctctgagtggagtgctttctatgtcccagggctctgactgggctggggtccttgaggggattggaggaaggagcatgggatggagagctaagttcaagcagcctgggatctctagtataggtggctgaggctgatagaagacaggagggacctgtatccatggggtttggccaactctggggccggtagtggaggaggggagagctggatccccagctggtgaacaaagtgtttggagggcagccgagcctccccttctgactgctatcccaccacaaccaggatcagagctgcatttgggggctgatgtgtggctactgccagcagaccccaaggtgaggtctctagatggtgagtcagcagccctagaggaccccctgctcccaccccagagctctctgtgaccctgggtcctcaccctgcccttctctcctgcccagcccagaagattagccagctggctgcggtgaaccgggaaagcaagttccgcgtggtcatccagcctgaagccctcttcagcatctactccaaggccgtgtccctggaggtggggctgcagcacttcctcagctttctgagctccatgcgccgccctatcttggcctgctacaagctgtgggggcctggcctcccaaacttcttccgggccctggaggacattaacaggctgtgggaattccaggaggccatctcgggcttcctggctgccctgcctctcatccgggagcgtgtgcccggggccagcagcttcaaactcaagaacctggcccagacctacctggcgagaaacatgagcgagcgcagcgccatggctgccgtgctggccatgcgtgacctgtgccgcctcctcgaggtctccccgggcccccagctggcccagcatgtctaccccttcagtagcctgcagtgctttgcctccctgcagcccctggtgcaggcagctgtgctgccccgggctgaggcccgcctcctggccctacacaacgtgagcttcatggagctgctgagtgcacaccgccgtgaccggcaggggggcctgaagaagtacagccgctatctaagcctgcagaccaccacgttgccccctgcccagcctgctttcaacctgcaggctctgggcacctactttgaaggcctgttggagggtccggcgctggcacgggcagaaggagtctccaccccacttgctggccgtggcttggcagagagggcctcccagcagagctgagaggagggggtgaccagcttggagtctctggtgggcagagagggatggggtccctgagccaggccccacccatcacagcattcccaggtcctggtacccagccctcagttgtcatttggttcagaatcagttccctttctctgggaccaaatttcccttctctaaacatcctacagagaaggttccaaagctgagcacccatcaccctaggtgtgcaccagactcctattagcccctccttccaggagctagaaccagggaggtcctgagtgaggaaggcatgacctctgggctctctaggtggccctggtcttgccccatccatcccacctgccactaccttgggtgtccttacagctctgccctgaccccagcccctgcccctggacacctgctgacagctcccacacagaacagtctgaggtgatgctggctacagccctggcagcccatggcaactcaaagtgccttccaaaccaaactgcccctcatgaggttagggtcccccaccctccacctgcccagaggccaactctgttcccttctcctttcatcccagaggggcctcatcagcaaagacagaaactgatgttccatgcatgtccctgcttccaaagcctgaccttccaaagcttgcttccttcctcctggctgcacagacacctctgcttggccacagctttgctctttggtcctcaggccaccagacccctcacagcatggcccttggctcttcctgcactgccctcaccctcagccgtcccaaggagtgcccagcactactcagcatgtagtccaggacctgcggcatcagcatcccctgggagcttcttagaaatgcagacctgtgggctctaccacaggcctctggaatcagaatcttcagggtggggcccagcagtctgtgttttaacaggttctcccggtgatgctggtgcatgctcaagtttgagaaccgctgctctcatagactgctcctccaaggggaagcagtgtggaacagcagagaaagtcccgtccctatctctgactgtgcagtgagtgtggcctaggaacaggtcccttcctaagctctagtgtccccatctgtaaaatgggctgattggcctccacggtcagagcggccatctggctgtgccatcctgcatttttaggaatggaaagcaggcctctgaggcagtggacaggaagacttctcatccttgaattctagctcccattccaaactgttagtccccaaccttgtggtcacatcagaggtcaacagcagaacagaggcaggtcagggttgtccgctctgattagcagaacgacagccccttcctcctcctccctccttcccatccctactcattagctccctgctcctgggatgcttcccaagcagcccaggcctctagcctccatggctgatgacctcagctttcacactggtgaagtctgtgtacccatactgcagccccatcccatggggcccctgaagacccactgaggaattccgtagggtcttgttcccacgaccggagtgctggctctcacagtgaattttgatgcatttaaaataagattctgatgccagactgttaaaataggcgctggttctgaagcaccgatggaaacagattgatgcagatggaaggaggaagggagactgggcccactgatttccagccccaccatgtgtgctgttttcagatgtgattgaggggtgttctgccctgcctccactgtcacagcctttaataaagatgtgaatcttgaaaaaaaaaaa

SEQ ID NO: 72215 - DNA, 2011 bp, Homo sapiens
tgatgctgatgtgatctagaggatcccgaggctctctcgtgtgggggcctgaagaagtacagccgctatctaagcctgcagaccaccacgttgccccctgcccagcctgctttcaacctgcaggctctgggcacctactttgaaggcctgttggagggtccggcgctggcacgggcagaaggagtctccaccccacttgctggccgtggcttggcagagagggcctcccagcagagctgagaggagggggtgaccagcttggagtctctggtgggcagagagggatggggtccctgagccaggccccacccatcacagcattcccaggtcctggtacccagccctcagttgtcatttggttcagaatcagttccctttctctgggaccaaatttcccttctctaaacatcctacagagaaggttccaaagctgagcacccatcaccctaggtgtgcaccagactcctattagcccctccttccaggagctagaaccagggaggtcctgagtgaggaaggcatgacctctgggctctctaggtggccctggtcttgccccatccatcccacctgccactaccttgggtgtccttacagctctgccctgaccccagcccctgcccctggacacctgctgacagctcccacacagaacagtctgaggtgatgctggctacagccctggcagcccatggcaactcaaagtgccttccaaaccaaactgcccctcatgaggttagggtcccccaccctccacctgcccagaggccaactctgttcccttctcctttcatcccagaggggcctcatcagcaaagacagaaactgatgttccatgcatgtccctgcttccaaagcctgaccttccaaagcttgcttccttcctcctggctgcacagacacctctgcttggccacagctttgctctttggtcctcaggccaccagacccctcacagcatggcccttggctcttcctgcactgccctcaccctcagccgtcccaaggagtgcccagcactactcagcatgtagtccaggacctgcggcatcagcatcccctgggagcttcttagaaatgcagacctgtgggctctaccacaggcctctggaatcagaatcttcagggtggggcccagcagtctgtgttttaacaggttctcccggtgatgctggtgcatgctcaagtttgagaaccgctgctctcatagactgctcctccaaggggaagcagtgtggaacagcagagaaagtcccgtccctatctctgactgtgcagtgagtgtggcctaggaacaggtcccttcctaagctctagtgtccccatctgtaaaatgggctgattggcctccacggtcagagcggccatctggctgtgccatcctgcatttttaggaatggaaagcaggcctctgaggcagtggacaggaagacttctcatccttgaattctagctcccattccaaactgttagtccccaaccttgtggtcacatcagaggtcaacagcagaacagaggcaggtcagggttgtccgctctgattagcagaacgacagccccttcctcctcctccctccttcccatccctactcattagctccctgctcctgggatgcttcccaagcagcccaggcctctagcctccatggctgatgacctcagctttcacactggtgaagtctgtgtacccatactgcagccccatcccatggggcccctgaagacccactgaggaattccgtagggtcttgttcccacgaccggagtgctggctctcacagtgaattttgatgcatttaaaataagattctgatgccagactgttaaaataggcgctggttctgaagcaccgatggaaacagattgatgcagatggaaggaggaagggagactgggcccactgatttccagccccaccatgtgtgctgttttcagatgtgattgaggggtgttctgccctgcctccactgtcacagcctttaataaagatgtgaatcttgaaaaaaaaaaa

SEQ ID NO: 72216 - DNA, 1699 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagacaagagaacttgaacgttgccattgagacccagagcagcagttctg

SEQ ID NO: 72217 - DNA, 3656 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtgcatggagcccatggagaccgccgagccacatcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaggcagagcccagactcttggagcagttgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcacccttgcgaacccttattccacgaccatcgcgttctccgatggatccagctcctccctgcaggctgttctctcttccctatgctggaactcagttctcctctggggataccatgtcccctcttcctcccacactcatgggcatcagaggtgggaggtagggtcaaggccccctgcttcctggactgttccagccccttcctggccgtctggtaagatcctctgtccctctcagggtgggccccatgctccccagctcatcccagacacccacctgcccaccctcattgagggcagacgtgagcattcacctcccagatttcttctccctgctcaggtcctgccttcctcctgagtgacttctatttccacccacctgcccgccactccttaacctctcaggggttgtcaccccattcccccagacagctgcctgccccgtggccgtgccctgcaccttgccatcaccgagcactgttggtccctcagccggtcctctcagactctgac

SEQ ID NO: 72218 - DNA, 4223 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcggtgagtggcccagaagttcagcccaggactcctgcctccccccatttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagccctgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaggcagagcccagactcttggagcagttgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcacccttgcgaacccttattccacgaccatcgcgttctccgatggatccagctcctccctgcaggctgttctctcttccctatgctggaactcagttctcctctggggataccatgtcccctcttcctcccacactcatgggcatcagaggtgggaggtagggtcaaggccccctgcttcctggactgttccagccccttcctggccgtctggtaagatcctctgtccctctcagggtgggccccatgctccccagctcatcccagacacccacctgcccaccctcattgagggcagacgtgagcattcacctcccagatttcttctccctgctcaggtcctgccttcctcctgagtgacttctatttccacccacctgcccgccactccttaacctctcaggggttgtcaccccattcccccagacagctgcctgccccgtggccgtgccctgcaccttgccatcaccgagcactgttggtccctcagccggtcctctcagactctgac

SEQ ID NO: 72219 - DNA, 3566 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtgcatggagcccatggagaccgccgagccacatcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaggcagagcccagactcttggagcagttgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcacccttgcgaacccttattccacgaccatcgcgttctccgatggatccagctcctccctgcaggctgttctctcttccctatgctggaactcagttctcctctggggataccatgtcccctcttcctcccacactcatgggcatcagaggtgggaggtagggtcaaggccccctgcttcctggactgttccagccccttcctggccgtctggtaagatcctctgtccctctcagggtgggccccatgctccccagctcatcccagacacccacctgcccaccctcattgagggcagacgtgagcattcacctcccagatttcttctccctgctcaggtcctgccttcctcctgagtgacttctatttccacccacctgcccgccactccttaacctctcaggggttgtcaccccattcccccagacagctgcctgccccgtggccgtgccctgcaccttgccatcaccgagcactgttggtccctcagccggtcctctcagactctgac

SEQ ID NO: 72220 - DNA, 2201 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgcctta

SEQ ID NO: 72221 - DNA, 3663 bp, Homo sapiens
aattaggctaggtaagagggccgggttggtttaatcggccgaggcttagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaacccagaagattagccagctggctgcggtgaaccgggaaagcaagttccgcgtggtcatccagcctgaagccctcttcagcatctactccaaggccgtgtccctggaggtggggctgcagcacttcctcagctttctgagctccatgcgccgccctatcttggcctgctacaagctgtgggggcctggcctcccaaacttcttccgggccctggaggacattaacaggctgtgggaattccaggaggccatctcgggcttcctggctgccctgcctctcatccgggagcgtgtgcccggggccagcagcttcaaactcaagaacctggcccagacctacctggcgagaaacatgagcgagcgcagcgccatggctgccgtgctggccatgcgtgacctgtgccgcctcctcgaggtctccccgggcccccagctggcccagcatgtctaccccttcagtagcctgcagtgctttgcctccctgcagcccctggtgcaggcagctgtgctgccccgggctgaggcccgcctcctggccctacacaacgtgagcttcatggagctgctgagtgcacaccgccgtgaccggcaggggggcctgaagaagtacagccgctatctaagcctgcagaccaccacgttgccccctgcccagcctgctttcaacctgcaggctctgggcacctactttgaaggcctgttggagggtccggcgctggcacgggcagaaggagtctccaccccacttgctggccgtggcttggcagagagggcctcccagcagagctgagaggagggggtgaccagcttggagtctctggtgggcagagagggatggggtccctgagccaggccccacccatcacagcattcccaggtcctggtacccagccctcagttgtcatttggttcagaatcagttccctttctctgggaccaaatttcccttctctaaacatcctacagagaaggttccaaagctgagcacccatcaccctaggtgtgcaccagactcctattagcccctccttccaggagctagaaccagggaggtcctgagtgaggaaggcatgacctctgggctctctaggtggccctggtcttgccccatccatcccacctgccactaccttgggtgtccttacagctctgccctgaccccagcccctgcccctggacacctgctgacagctcccacacagaacagtctgaggtgatgctggctacagccctggcagcccatggcaactcaaagtgccttccaaaccaaactgcccctcatgaggttagggtcccccaccctccacctgcccagaggccaactctgttcccttctcctttcatcccagaggggcctcatcagcaaagacagaaactgatgttccatgcatgtccctgcttccaaagcctgaccttccaaagcttggggaatgtcctcggcttagaaccagtcttccgccttcagatctgctcttccaagaggagagctccctggagagccacagtactgtctctttaggccacccctcccatcgttacagcagggtcatttatggcagccactagaacctcgtttttagagccttccattgtcccggggccagggaaatgtcctttgtcctaaacttactcgagctgccttctctaagaaacctctactgtctcctttaataaaaggacaccccctttccaccaagctt

SEQ ID NO: 72222 - DNA, 1798 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgcctta

SEQ ID NO: 72223 - DNA, 4524 bp, Homo sapiens
aattaggctaggtaagagggccgggttggtttaatcggccgaggcttagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaacccagaagattagccagctggctgcggtgaaccgggaaagcaagttccgcgtggtcatccagcctgaagccctcttcagcatctactccaaggccgtgtccctggaggtggggctgcagcacttcctcagctttctgagctccatgcgccgccctatcttggcctgctacaagctgtgggggcctggcctcccaaacttcttccgggccctggaggacattaacaggctgtgggaattccaggaggccatctcgggcttcctggctgccctgcctctcatccgggagcgtgtgcccggggccagcagcttcaaactcaagaacctggcccagacctacctggcgagaaacatgagcgagcgcagcgccatggctgccgtgctggccatgcgtgacctgtgccgcctcctcgaggtctccccgggcccccagctggcccagcatgtctaccccttcagtagcctgcagtgctttgcctccctgcagcccctggtgcaggcagctgtgctgccccgggctgaggcccgcctcctggccctacacaacgtgagcttcatggagctgctgagtgcacaccgccgtgaccggcaggggggcctgaagaagtacagccgctatctaagcctgcagaccaccacgttgccccctgcccagcctgctttcaacctgcaggctctgggcacctactttgaaggcctgttggagggtccggcgctggcacgggcagaaggagtctccaccccacttgctggccgtggcttggcagagagggcctcccagcagagctgagaggagggggtgaccagcttggagtctctggtgggcagagagggatggggtccctgagccaggccccacccatcacagcattcccaggtcctggtacccagccctcagttgtcatttggttcagaatcagttccctttctctgggaccaaatttcccttctctaaacatcctacagagaaggttccaaagctgagcacccatcaccctaggtgtgcaccagactcctattagcccctccttccaggagctagaaccagggaggtcctgagtgaggaaggcatgacctctgggctctctaggtggccctggtcttgccccatccatcccacctgccactaccttgggtgtccttacagctctgccctgaccccagcccctgcccctggacacctgctgacagctcccacacagaacagtctgaggtgatgctggctacagccctggcagcccatggcaactcaaagtgccttccaaaccaaactgcccctcatgaggttagggtcccccaccctccacctgcccagaggccaactctgttcccttctcctttcatcccagaggggcctcatcagcaaagacagaaactgatgttccatgcatgtccctgcttccaaagcctgaccttccaaagcttgcttccttcctcctggctgcacagacacctctgcttggccacagctttgctctttggtcctcaggccaccagacccctcacagcatggcccttggctcttcctgcactgccctcaccctcagccgtcccaaggagtgcccagcactactcagcatgtagtccaggacctgcggcatcagcatcccctgggagcttcttagaaatgcagacctgtgggctctaccacaggcctctggaatcagaatcttcagggtggggcccagcagtctgtgttttaacaggttctcccggtgatgctggtgcatgctcaagtttgagaaccgctgctctcatagactgctcctccaaggggaagcagtgtggaacagcagagaaagtcccgtccctatctctgactgtgcagtgagtgtggcctaggaacaggtcccttcctaagctctagtgtccccatctgtaaaatgggctgattggcctccacggtcagagcggccatctggctgtgccatcctgcatttttaggaatggaaagcaggcctctgaggcagtggacaggaagacttctcatccttgaattctagctcccattccaaactgttagtccccaaccttgtggtcacatcagaggtcaacagcagaacagaggcaggtcagggttgtccgctctgattagcagaacgacagccccttcctcctcctccctccttcccatccctactcattagctccctgctcctgggatgcttcccaagcagcccaggcctctagcctccatggctgatgacctcagctttcacactggtgaagtctgtgtacccatactgcagccccatcccatggggcccctgaagacccactgaggaattccgtagggtcttgttcccacgaccggagtgctggctctcacagtgaattttgatgcatttaaaataagattctgatgccagactgttaaaataggcgctggttctgaagcaccgatggaaacagattgatgcagatggaaggaggaagggagactgggcccactgatttccagccccaccatgtgtgctgttttcagatgtgattgaggggtgttctgccctgcctccactgtcacagcctttaataaagatgtgaatcttgaaaaaaaaaaa

SEQ ID NO: 72224 - DNA, 3805 bp, Homo sapiens
acgctctctctgtggggcacggtggtggacgcctgtagtcccacctacttgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcggtgagtggcccagaagttcagcccaggactcctgcctccccccatttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagccctgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaggcagagcccagactcttggagcagttgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcacccttgcgaacccttattccacgaccatcgcgttctccgatggatccagctcctccctgcaggctgttctctcttccctatgctggaactcagttctcctctggggataccatgtcccctcttcctcccacactcatgggcatcagaggtgggaggtagggtcaaggccccctgcttcctggactgttccagccccttcctggccgtctggtaagatcctctgtccctctcagggtgggccccatgctccccagctcatcccagacacccacctgcccaccctcattgagggcagacgtgagcattcacctcccagatttcttctccctgctcaggtcctgccttcctcctgagtgacttctatttccacccacctgcccgccactccttaacctctcaggggttgtcaccccattcccccagacagctgcctgccccgtggccgtgccctgcaccttgccatcaccgagcactgttggtccctcagccggtcctctcagactctgac

SEQ ID NO: 72225 - DNA, 3107 bp, Homo sapiens
agactgaaacaggagaattgctcaagcccaggagttcaagaccagcgtgggcaacatagtgagaccctgtctctacaaaaaaatttttttaaaaaaaggaggtgatgtgatggagagtttggaggacttcttgtccccagtgagctcggagctttgagtcagggagcctggacctgtgacttggtgaggccccagggattaggccaaccacaggtctggggtacctggccctggggctgctgcctagtcatttctgactcaattttcccaactttgcagcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcggtgagtggcccagaagttcagcccaggactcctgcctccccccatttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagccctgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaaggcagagcccagactcttggagcagttgttccccctggggactctgtcagaggctccatggaggcctctcaagtccaagtgcctctggaagcctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctgggcagggagacctgggtcttctctggctgagaggggaaggctaaggcatggctgagattcaagccaccattccaggcctctttgcccaagaaagaaacttctgtcacccttgcactctcctgtattctgagtccctggccaatagcacagccttccatgccccgacccccaccccaagcctctccactaggcctctgccaggatctaagcccatgagcacagggactggctatcccaagacctggcagatgtggctgctcaataaacacttgttgaaccatcacccttgcgaacccttattccacgaccatcgcgttctccgatggatccagctcctccctgcaggctgttctctcttccctatgctggaactcagttctcctctggggataccatgtcccctcttcctcccacactcatgggcatcagaggtgggaggtagggtcaaggccccctgcttcctggactgttccagccccttcctggccgtctggtaagatcctctgtccctctcagggtgggccccatgctccccagctcatcccagacacccacctgcccaccctcattgagggcagacgtgagcattcacctcccagatttcttctccctgctcaggtcctgccttcctcctgagtgacttctatttccacccacctgcccgccactccttaacctctcaggggttgtcaccccattcccccagacagctgcctgccccgtggccgtgccctgcaccttgccatcaccgagcactgttggtccctcagccggtcctctcagactctgac

SEQ ID NO: 72226 - DNA, 4474 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaacccagaagattagccagctggctgcggtgaaccgggaaagcaagttccgcgtggtcatccagcctgaagccctcttcagcatctactccaaggccgtgtccctggaggtggggctgcagcacttcctcagctttctgagctccatgcgccgccctatcttggcctgctacaagctgtgggggcctggcctcccaaacttcttccgggccctggaggacattaacaggctgtgggaattccaggaggccatctcgggcttcctggctgccctgcctctcatccgggagcgtgtgcccggggccagcagcttcaaactcaagaacctggcccagacctacctggcgagaaacatgagcgagcgcagcgccatggctgccgtgctggccatgcgtgacctgtgccgcctcctcgaggtctccccgggcccccagctggcccagcatgtctaccccttcagtagcctgcagtgctttgcctccctgcagcccctggtgcaggcagctgtgctgccccgggctgaggcccgcctcctggccctacacaacgtgagcttcatggagctgctgagtgcacaccgccgtgaccggcaggggggcctgaagaagtacagccgctatctaagcctgcagaccaccacgttgccccctgcccagcctgctttcaacctgcaggctctgggcacctactttgaaggcctgttggagggtccggcgctggcacgggcagaaggagtctccaccccacttgctggccgtggcttggcagagagggcctcccagcagagctgagaggagggggtgaccagcttggagtctctggtgggcagagagggatggggtccctgagccaggccccacccatcacagcattcccaggtcctggtacccagccctcagttgtcatttggttcagaatcagttccctttctctgggaccaaatttcccttctctaaacatcctacagagaaggttccaaagctgagcacccatcaccctaggtgtgcaccagactcctattagcccctccttccaggagctagaaccagggaggtcctgagtgaggaaggcatgacctctgggctctctaggtggccctggtcttgccccatccatcccacctgccactaccttgggtgtccttacagctctgccctgaccccagcccctgcccctggacacctgctgacagctcccacacagaacagtctgaggtgatgctggctacagccctggcagcccatggcaactcaaagtgccttccaaaccaaactgcccctcatgaggttagggtcccccaccctccacctgcccagaggccaactctgttcccttctcctttcatcccagaggggcctcatcagcaaagacagaaactgatgttccatgcatgtccctgcttccaaagcctgaccttccaaagcttgcttccttcctcctggctgcacagacacctctgcttggccacagctttgctctttggtcctcaggccaccagacccctcacagcatggcccttggctcttcctgcactgccctcaccctcagccgtcccaaggagtgcccagcactactcagcatgtagtccaggacctgcggcatcagcatcccctgggagcttcttagaaatgcagacctgtgggctctaccacaggcctctggaatcagaatcttcagggtggggcccagcagtctgtgttttaacaggttctcccggtgatgctggtgcatgctcaagtttgagaaccgctgctctcatagactgctcctccaaggggaagcagtgtggaacagcagagaaagtcccgtccctatctctgactgtgcagtgagtgtggcctaggaacaggtcccttcctaagctctagtgtccccatctgtaaaatgggctgattggcctccacggtcagagcggccatctggctgtgccatcctgcatttttaggaatggaaagcaggcctctgaggcagtggacaggaagacttctcatccttgaattctagctcccattccaaactgttagtccccaaccttgtggtcacatcagaggtcaacagcagaacagaggcaggtcagggttgtccgctctgattagcagaacgacagccccttcctcctcctccctccttcccatccctactcattagctccctgctcctgggatgcttcccaagcagcccaggcctctagcctccatggctgatgacctcagctttcacactggtgaagtctgtgtacccatactgcagccccatcccatggggcccctgaagacccactgaggaattccgtagggtcttgttcccacgaccggagtgctggctctcacagtgaattttgatgcatttaaaataagattctgatgccagactgttaaaataggcgctggttctgaagcaccgatggaaacagattgatgcagatggaaggaggaagggaggaggaggaaggtgctgtcgttctgctaatcagag

SEQ ID NO: 72227 - DNA, 2239 bp, Homo sapiens
gctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgccttatccagtgcctgagtgtgcgagagaggcagatgcctcca

SEQ ID NO: 72228 - DNA, 361 bp, Homo sapiens
ccacatgtaactgatgactagtggctacctaccatatatagaacatttctattattgcacattattctactggacaatgctgttttaggatgtagaagtcctgatggataatatcaaagccaccttaccacagacagagttttacagagctgtgaagtaattcttactgggaacaccagatacttacttaccattttatatagcgtatgtggcattctctcatcttatcattagagcatgcctgtatctttagcgacaatagcattcaaacaccaaatgttatattgtctgtctggaaatgttttcttatacaactcaaaggggaagagaggaatatgtcgtgagtaaatggaattatttt

SEQ ID NO: 72229 - DNA, 474 bp, Homo sapiens
ggttcagggaggccaagtaactgacctagatttagtggaagaactgggattggaagtcaggaatgccgaaatctagtggagattccttctgtcactctgtgttcctgctgtgcagaaaggtcctcagattgtggtagcctaacatggaaaatcatgggctttggagaacagcagatccgagacgaaatctatgttctaccattacgttatgagaatttagacaagttgtttactatctctgaccctatttatcatataaatggggacaataaactgttaaagattaagagaaaacactataaaatatctaccagagtatctgggtttgaatcctggctttgcctttttctaattgattgcgtgacaaacggcagaaatgtcatacagtagaaatgagagatgagaggtcctctgggtaagtggggaactgtttggtctcatcgcctccatttctacatctctaataatatccct

SEQ ID NO: 72230 - DNA, 507 bp, Homo sapiens
gaaaaaagagagctccttctggctcctggtgacccatatttaggacaccatcccatcccccagcacacacattcctacagtgtcacctggtccccaatccgagcatttcctggagtgctcgccacattccccttcctggtgcttttctatggtggggccaggggaggccttgttttgaacatcgctgtgacgtcactccccctcctccgagctaagcacccctcggtgggccctgggaattgttgcgcggcctgctggggaggggcggagtgtgggcccagggagggttccaccaaacatccattaccgctgtcgcctgcggggccttcaggctgcaagtacgtgaggtgtcagaaaagaagccgaagggttcccgtgggggctcttctgccaaatgagtcaagagatgtgcggaagcggatgattgaagtaccccgtggagtagcagaaaggggcatcaaaaactgtaacctgaaaataaaagctttaacctgttccccaaaagac

SEQ ID NO: 72231 - DNA, 422 bp, Homo sapiens
gctcaaaaaacaaaaggatggaggcacaggagccaacctgagagagctctcaatggccaaagctaaaacaattttagcaacaaactaaatgacatagtattagcttatggcacaaagaatagaataaatatctgtgagcccatactgattacataaaataaatgattgagtaaatcaatggagaacaagtctttctcacagaagaatttgaaataatatatgaggacactcctgtttttagaaggtggagtttagttcctccctaccctctttaatgactcagccccaaagaataaaatgtgaaagggaaaaatactgaatgtggaaaaacctggcaaatatcataatttattaaactagccttctgttgatggtcatttaggttgtttcttatcttttagtatttgaatctagcagtaagt

SEQ ID NO: 72232 - DNA, 621 bp, Homo sapiens
cttgcaacaaaatcaaggttccagaagctcaaagcattactgattttcttggtaattaccagtacaccaaaaacagcattttagaagggagcaccaagccctgtggaatgcttctgaactagattaaactactagactagtaattaaactaacttcatatgggagagttctcttgctcaaacttgagcaatcctgctcatttcaggaaagcaattttagcacaaaagtggaaacaagaaacttctgagcctcaatttcagctcagataccatggttggcagcctctattcacctgaactacaaaaccaggataccaactacttccaagaagtgttaaaggggattaagattattaaataatgtgaagatgaaaagcactaagtcccagtattgtatcatttgcaggtagtttaacagtctctgtttctgtatcagcaaacaagttcctaccattttactcatctagacatttcaataacagtcactgccacagtacctaagtgctttttaccagacaacccattgaaagactcctggcatcttgtcaaaatgacatgctgctacatcatattacagactgcaagagcctaaaaatttagaaaagatgatttttcttcaaat

SEQ ID NO: 72233 - DNA, 568 bp, Homo sapiens
cttgcaacaaaatcaaggttccagaagctcaaagcattactgattttcttggtaattaccagtacaccaaaaacagcattttagaagggagcaccaagccctgtggaatgcttctgaactagattaaactactagactagtaattaaactaacttcatatgggagagttctcttgctcaaacttgagcaatcctgctcatttcaggaaagcaattttagcacaaaagtggaaacaagaaacttctgagcctcaatttcagctcagataccatggttggcagcctctattcacctgaactacaaaaccaggataccaactacttccaagaagtgttaaaggggattaagattattaaataatgtgaagatgaaaagcactaagtcccagtattgtatcatttgcagtcatctagacatttcaataacagtcactgccacagtacctaagtgctttttaccagacaacccattgaaagactcctggcatcttgtcaaaatgacatgctgctacatcatattacagactgcaagagcctaaaaatttagaaaagatgatttttcttcaaat

SEQ ID NO: 72234 - DNA, 166 bp, Homo sapiens
tacccccggatttctacatggctccgtcctcctttcctccgtgctaccctccgatttctaaatggctccgtcctcctttccaaatatttattcctccgtattgtatttccctggccacttttcttaccagcaatcttacaccttccatttaatatagccaaagttt

SEQ ID NO: 72235 - DNA, 428 bp, Homo sapiens
aactttcattccatgcctatgtctgtacttaaggtacaggtaatgttgaaatgaaggatatctttcagcagggttttccatcttctcactgtcatgctgcaaactaacttaccaatgtaatgtccatatctggcagatatctcaatgatagagaatactacaagacagtagttcccaaactttgctgcacattagaatttcctgaggttctttggaaaagtcctgatgcctagggctcactttgagagattctgatttttgttttgttttgttttgtttttttaaccacagcactgagttttattagggatttcattaaggttaaatttctaggaatgagggaatcctagttagagggcacaaaagcccacgaagcctcctcagatctagtagtgaaccaccgactcaggttctttggagggatcacc

SEQ ID NO: 72236 - DNA, 2013 bp, Homo sapiens
atggcagcagattcacagggcctctgagcattatcccccatactcctccccatcattctccacccagctgttggagccatctgtctgatcaccttggactccatagtacactggggcaaagcacagccccagtttctggaggcagatgggtaaccaggaaaaggcatgaatgagggggccccaggagacagtgacttagagactgaggcaagagtgccgtggtcaatcatgggtcattgtcttcgaactggacaggccagaatgtctgccacacccacacctgcaggtgaaggagccagaagctcttcaacctgtagctccctgagcaggctgttctggtctcaacttgagcacataaactgggatggagccacagccaagaactttattaatttaagggagttcttctcttttctgctccctgcattgagaaaagctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctacattaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataaagttgaacttgtttttctcatgcatatgatt

SEQ ID NO: 72237 - DNA, 2037 bp, Homo sapiens
atggcagcagattcacagggcctctgagcattatcccccatactcctccccatcattctccacccagctgttggagccatctgtctgatcaccttggactccatagtacactggggcaaagcacagccccagtttctggaggcagatgggtaaccaggaaaaggcatgaatgagggggccccaggagacagtgacttagagactgaggcaagagtgccgtggtcaatcatgggtcattgtcttcgaactggacaggccagaatgtctgccacacccacacctgcaggtgaaggagccagaagggatgaactttttgggattctccaaatactccatcagtgtatcctgtcttcaggtgatgcttttgttcttactggcgtctgttgttcctggaggcagaatggcaagccaccatattcacaaaaggaagataaggaagtacaaactggatacatgaatgctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctacattaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataaagttgaacttgtttttctcatgcatatgatt

SEQ ID NO: 72238 - DNA, 1879 bp, Homo sapiens
atggcagcagattcacagggcctctgagcattatcccccatactcctccccatcattctccacccagctgttggagccatctgtctgatcaccttggactccatagtacactggggcaaagcacagccccagtttctggaggcagatgggtaaccaggaaaaggcatgaatgagggggccccaggagacagtgacttagagactgaggcaagagtgccgtggtcaatcatgggtcattgtcttcgaactggacaggccagaatgtctgccacacccacacctgcaggtgaaggagccagaagctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctacattaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataaagttgaacttgtttttctcatgcatatgatt

SEQ ID NO: 72239 - DNA, 1940 bp, Homo sapiens
tggtaccatagagttgctctgaaaacagaagatagagggagtctcggagctcgcatctccagcgatctctacattgggaaaaaacatggagtcagctccggcagcccccgaccccgccgccagcgagccaggcagcagcggcgcggacgcggccgccggctccagggagaccccgctgaaccaggaatccgcccgcaagagcgagccgcctgccccggtgcgcagacagagctattccagcaccagcagaggtatctcagtaacgaagaagacacatacatggcaggcatggtacagagcgcttccttgcacagccttgcccatgagctcgtccctggcccggagggacccactctagaggtgctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctacattaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataaagttgaacttgtttttctcatgcatatgatt

SEQ ID NO: 72240 - DNA, 1854 bp, Homo sapiens
caaagctaggctgccactgctagttcctgtagtcatctctccgatatcatgactcaagccctccggtcgtcttggccacgttccccctggtttatccatattccacgtaaactgtgttcatcatactgaaaacagacccctggaggaattctgaggtccaaggatttgggcaaggtcattacctcctttttcctggaccatcttcttcaattaatgcaacctaagactgcaataagctcttttacaggtatctcagtaacgaagaagacacatacatctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctacattaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataaagttgaacttgtttttctcatgcatatgatt

SEQ ID NO: 72241 - DNA, 1858 bp, Homo sapiens
tggtaccatagagttgctctgaaaacagaagatagagggagtctcggagctcgcatctccagcgatctctacattgggaaaaaacatggagtcagctccggcagcccccgaccccgccgccagcgagccaggcagcagcggcgcggacgcggccgccggctccagggagaccccgctgaaccaggaatccgcccgcaagagcgagccgcctgccccggtgcgcagacagagctattccagcaccagcagaggtatctcagtaacgaagaagacacatacatctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctacattaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataaagttgaacttgtttttctcatgcatatgatt

SEQ ID NO: 72242 - DNA, 1699 bp, Homo sapiens
tgtggctcgggcggcggcggcgcggcggcggcagagggggctccggggtcggaccatccgctctccctgcgctctccgcaccgcggcttaaatgatgtattttgtgatcgcagcgatgaaagctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctacattaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataaagttgaacttgtttttctcatgcatatgatt

SEQ ID NO: 72243 - DNA, 1245 bp, Homo sapiens
tggtaccatagagttgctctgaaaacagaagatagagggagtctcggagctcgcatctccagcgatctctacattgggaaaaaacatggagtcagctccggcagcccccgaccccgccgccagcgagccaggcagcagcggcgcggacgcggccgccggctccagggagaccccgctgaaccaggaatccgcccgcaagagcgagccgcctgccccggtgcgcagacagagctattccagcaccagcagaggtatctcagtaacgaagaagacacatacatctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattaggtaatggcatgcatgcttctcctgggatgctctattcatgccctttgaagtaaaaggggtatgtctgactttcctctaatgagttctgctaaatgatgcaattcacctttaccatttgggccacttaattttctgccctgcccccttgcttttgaccctctgctgtttcccatggtttatccaatacatgcattgacctctcagcattagaaatggggcaaaaccaacggaagcagtctttgaattctgcagaaaactgtaagttcaggaaatggctacattaacttcattagtggtttactttagttatattccaaggattgctttatacctaaggtga

SEQ ID NO: 72244 - DNA, 1132 bp, Homo sapiens
tggtaccatagagttgctctgaaaacagaagatagagggagtctcggagctcgcatctccagcgatctctacattgggaaaaaacatggagtcagctccggcagcccccgaccccgccgccagcgagccaggcagcagcggcgcggacgcggccgccggctccagggagaccccgctgaaccaggaatccgcccgcaagagcgagccgcctgccccggtgcgcagacagagctattccagcaccagcagaggtatctcagtaacgaagaagacacatacatctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccatcggccgcgggtgtaccggctcgattcgtatc

SEQ ID NO: 72245 - DNA, 1781 bp, Homo sapiens
ctggtaaccattcagtcatctatttcaacaccctgacatgacataaaggcaggcgtggaaccacacgttcaccacacagacacacacctccttgctggagcattcactaggcgaggcgctccatcggactcactagccgcactcatgaatcggcaccatctgcaggatcactttctggaaatagacaagaagaactgctgtgtgttccgagatgacttcattgtcaaggtgttgccgccggtgttggggctggagtttatcttcgggcttctgggcaatggccttgccctgtggattttctgtttccacctcaagtcctggaaatccagccggattttcctgttcaacctggcagtggctgactttctactgatcatctgcctgcccttcctgatggacaactatgtgaggcgttgggactggaagtttggggacatcccttgccggctgatgctcttcatgttggctatgaaccgccagggcagcatcatcttcctcacggtggtggcggtagacaggtatttccgggtggtccatccccaccacgccctgaacaagatctccaatcggacagcagccatcatctcttgccttctgtggggcatcactattggcctgacagtccacctcctgaagaagaagatgccgatccagaatggcggtgcaaatttgtgcagcagcttcagcatctgccataccttccagtggcacgaagccatgttcctcctggagttcttcctgcccctgggcatcatcctgttctgctcagccagaattatctggagcctgcggcagagacaaatggaccggcatgccaagatcaagagagccatcaccttcatcatggtggtggccatcgtctttgtcatctgcttccttcccagcgtggttgtgcggatccgcatcttctggctcctgcacacttcgggcacgcagaattgtgaagtgtaccgctcggtggacctggcgttctttatcactctcagcttcacctacatgaacagcatgctggaccccgtggtgtactacttctccagcccatcctttcccaacttcttctccactttgatcaaccgctgcctccagaggaagatgacaggtgagccagataataaccgcagcacgagcgtcgagctcacaggggaccccaacaaaaccagaggcgctccagaggcgttaatggccaactccggtgagccatggagcccctcttatctgggcccaacctctccttaaataaccatgccaagaagggacattgtcaccaagaaccaggatctctggagaaacagttgggctgttgcatcgagtaatgtcactggactcggcctaaggtttcctggaacttccagattcagagaatgcgatttagggaaacggtggcagatgagtgggagactggttgcaaggtgtgaccgcaggaatcctggaggaatagagagtaaagcttctaggcatctgaaacttttgcttcatctctgacgctcgcaggactgaagatgggcaaattgtaggcatttctgctgagcagagttggagccagagatctacttgtgacttgttggccttcttcccacatctgcctcagactggagggggctcagctcctggggtgatatctagcctgcttgtgagctctagcagggataaggagagctgagattggagggaattgtgttgctcctggagggagcccaggcatcattaaacaagccagtaggtcacctggcttccgtggaccaattcatctttcagaatccaaatcagggtccggagctcgc

SEQ ID NO: 72246 - DNA, 2143 bp, Homo sapiens
ctggtaaccattcagtcatctatttcaacaccctgacatgacataaaggcaggcgtggaaccacacgttcaccacacagacacacacctccttgctggagcattcactaggcgaggcgctccatcggactcactagccgcactcatgaatcggcaccatctgcaggatcactttctggaaatagacaagaagaactgctgtgtgttccgagatgacttcattgtcaaggtgttgccgccggtgttggggctggagtttatcttcgggcttctgggcaatggccttgccctgtggattttctgtttccacctcaagtcctggaaatccagccggattttcctgttcaacctggcagtggctgactttctactgatcatctgcctgcccttcctgatggacaactatgtgaggcgttgggactggaagtttggggacatcccttgccggctgatgctcttcatgttggctatgaaccgccagggcagcatcatcttcctcacggtggtggcggtagacaggtatttccgggtggtccatccccaccacgccctgaacaagatctccaatcggacagcagccatcatctcttgccttctgtggggcatcactattggcctgacagtccacctcctgaagaagaagatgccgatccagaatggcggtgcaaatttgtgcagcagcttcagcatctgccataccttccagtggcacgaagccatgttcctcctggagttcttcctgcccctgggcatcatcctgttctgctcagccagaattatctggagcctgcggcagagacaaatggaccggcatgccaagatcaagagagccatcaccttcatcatggtggtggccatcgtctttgtcatctgcttccttcccagcgtggttgtgcggatccgcatcttctggctcctgcacacttcgggcacgcagaattgtgaagtgtaccgctcggtggacctggcgttctttatcactctcagcttcacctacatgaacagcatgctggaccccgtggtgtactacttctccagcccatcctttcccaacttcttctccactttgatcaaccgctgcctccagaggaagatgacaggtgagccagataataaccgcagcacgagcgtcgagctcacaggggaccccaacaaaaccagaggcgctccagaggcgttaatggccaactccggtgagccatggagcccctcttatctgggcccaacctctccttaaataaccatgccaagaagggacattgtcaccaagaaccaggatctctggagaaacagttgggctgttgcatcgagtaatgtcactggactcggcctaaggtttcctggaacttccagattcagagaatgcgatttagggaaacggtggcagatgagtgggagactggttgcaaggtgtgaccgcaggaatcctggaggaatagagagtaaagcttctaggcatctgaaacttttgcttcatctctgacgctcgcaggactgaagatgggcaaattgtaggcatttctgctgagcagagttggagccagagatctacttgtgacttgttggccttcttcccacatctgcctcagactggagggggctcagctcctggggtgatatctagcctgcttgtgagctctagcagggataaggagagctgagattggagggaattgtgttgctcctggagggagcccaggcatcattaaacaagccagtaggtcacctggcttccgtggaccaattcatctttcagacaagctttagcagaaatggactcagggaagagactcacacgctttggttaatatctgtgtttccggtgggtgtaataggggattagccccagaagggactgagctaaacagtgttattatgggaaaggaaatggcattgctgctttcaaccagcgactaatgcaatccattcctctcttgtttatagtaatctaagggttgggcagttaaaacggcttcaggatagaaagctgtttcccacctctgtttgcttttaacattaaaagggaaatgtgcctctgccccacagttagaggggtgcacgttcctcctggttccttcgcttgtgtttctgtacttaccaaaaatctaccatttcaataaattttgataggagacaaaaaagcg

SEQ ID NO: 72247 - DNA, 2170 bp, Homo sapiens
ctggtaaccattcagtcatctatttcaacaccctgacatgacataaaggcaggcgtggaaccacacgttcaccacacagacacacacctccttgctggagcattcactaggcgaggcgctccatcggactcactagccgcactcatgaatcggcaccatctgcaggatcactttctggaaatagacaagaagaactgctgtgtgttccgagatgacttcattgtcaaggtgttgccgccggtgttggggctggagtttatcttcgggcttctgggcaatggccttgccctgtggattttctgtttccacctcaagtcctggaaatccagccggattttcctgttcaacctggcagtggctgactttctactgatcatctgcctgcccttcctgatggacaactatgtgaggcgttgggactggaagtttggggacatcccttgccggctgatgctcttcatgttggctatgaaccgccagggcagcatcatcttcctcacggtggtggcggtagacaggtatttccgggtggtccatccccaccacgccctgaacaagatctccaatcggacagcagccatcatctcttgccttctgtggggcatcactattggcctgacagtccacctcctgaagaagaagatgccgatccagaatggcggtgcaaatttgtgcagcagcttcagcatctgccataccttccagtggcacgaagccatgttcctcctggagttcttcctgcccctgggcatcatcctgttctgctcagccagaattatctggagcctgcggcagagacaaatggaccggcatgccaagatcaagagagccatcaccttcatcatggtggtggccatcgtctttgtcatctgcttccttcccagcgtggttgtgcggatccgcatcttctggctcctgcacacttcgggcacgcagaattgtgaagtgtaccgctcggtggacctggcgttctttatcactctcagcttcacctacatgaacagcatgctggaccccgtggtgtactacttctccagcccatcctttcccaacttcttctccactttgatcaaccgctgcctccagaggaagatgacaggtgagccagataataaccgcagcacgagcgtcgagctcacaggggaccccaacaaaaccagaggcgctccagaggcgttaatggccaactccggtgagccatggagcccctcttatctgggcccaacctctccttaaataaccatgccaagaagggacattgtcaccaagaaccaggatctctggagaaacagttgggctgttgcatcgagtaatgtcactggactcggcctaaggtttcctggaacttccagattcagagaatgcgatttagggaaacggtggcagatgagtgggagactggttgcaaggtgtgaccgcaggaatcctggaggaatagagagtaaagcttctaggcatctgaaacttttgcttcatctctgacgctcgcaggactgaagatgggcaaattgtaggcatttctgctgagcagagttggagccagagatctacttgtgacttgttggccttcttcccacatctgcctcagactggagggggctcagctcctggggtgatatctagcctgcttgtgagctctagcagggataaggagagctgagattggagggaattgtgttgctcctggagggagcccaggcatcattaaacaagccagtaggtcacctggcgtgcacagctggaccgattgatctggtcacggcaatgccacacgcagaaagagcgatctcatgaggaagacgactcgagaccgcgatccgggcaacatgcacgtgttatgcctgagtgggctctgaataaggggattagccccagaagggactgagctaaacagtgttattatgggaaaggaaatggcattgctgctttcaaccagcgactaatgcaatccattcctctcttgtttatagtaatctaagggttgggcagttaaaacggcttcaggatagaaagctgtttcccacctctgtttgcttttaacattaaaagggaaatgtgcctctgccccacagttagaggggtgcacgttcctcctggttccttcgcttgtgtttctgtacttaccaaaaatctaccatttcaataaattttgataggagacaaaaaagcg

SEQ ID NO: 72248 - DNA, 573 bp, Homo sapiens
caaagaacatacattgggaaaaggacgcccccttcaataaatggtgctgtgaaaactcgatattcctattcagaaggatgaaactagactcctgtgtctcaccatatacaaaatccactgaaaattgattaaagacttaaatctaaaacttgagactgtgaaactactggaagaaaacataggggaaacacttgaggacattggtctaggcaaagattttatagctaagatatcaaaagagtaggcaacaacaacaacaaaaaacagacaaatgggactatattaaactaaaaagcttctgcacagcaacgaaaacaacagaatgaagagacaacctgttaaaataggggaacatatttggaaactactcatctgacaagggactaatatccagaatatacaaggaactcaaacaactcaacagtaaaaaaaaaaaaaaaaaaatccgacatttcccaaaagacatacaaatagccaacaggtatataaaaatacgctcaatatcactaatcatagctcattagtgatgttgagcacttcaacattttacctcatttagaatgactgttacta

SEQ ID NO: 72249 - DNA, 851 bp, Homo sapiens
ctcctgccaaccagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggcggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccgccgcctctatcacaacgaccacatccagatagcgaaccgtcacctcagccgcctgatggtggggccccacgctgctgtgcccaacctctgggacaaccctcccctgctgctgctgtcccagaggctgggtgcaggggctgcagccccagaaggcgagggcctcggcctgatccaggaggctgcgtcggtccag

SEQ ID NO: 72250 - DNA, 473 bp, Homo sapiens
cgagatggggtagggatagggagtaactcctaatgggcctaaaggtttctttttggggtgatgaaactgttctaaaattacattgtggtgatggctgtacagctctctaaatatacttcaacccattgaatagtacatttaaaatcagtgaattttatggcatgtaaatgatttctcaataaagtcgttaaaaaatcccaactcagtaaaataactcaatagggtaataggtatgataaaattaacatggaaaaatcaaaagccttcataaatgtaaacaataatgagttagaaggtataaggaaggctggtccaaaggtccaactgagttatctcaattgacttttcagtcagttatagattaaactccttgttctagtctttctccacttgttactactgcgcttgactagtcttaaaaaaaaagagatataatcgaagagaaaaccccatttacaatagcaagaaaaaaa

SEQ ID NO: 72251 - DNA, 605 bp, Homo sapiens
cctcccaagtagctgggactacaggcgcccactaccactgccggctagttttttgtatttttagtagagacggggtttcactgtgttagccaggatggtctcgatctcctgacctcgtgatccgcccgcctcagcctcccaaagtgtcattttattctttattatctgtccctcccactcgaatgtaaggtccataactcaggaatttctgtcactgtttctgttttgtacactgatataaccaaacactgaaaacagtgcctgatgcagttgatactcaataaatatttgttgagtaaggaggcaagaaagaatagtcccagggcaaaggtatagaacttgcctttagagagagaaagagcatctctaattggtaacagtaaggagggaggaatggataagagcagatctaaatgattttaaaatttagcatttggagattgagagaattccttttaaatagcatgtgatggttagttttgtgtgtcaacttggctaggctatagtacccagttatttaatcaaaccctaatttgggtgttactgtgaaggcatttttataggtatgggtaacatgtacacttagttgactttaaataaaggag

SEQ ID NO: 72252 - DNA, 273 bp, Homo sapiens
ggttgcagtgagccgagattgcgccactacactccagtctgggtgacagagtgagactccatctcaaaaaaaaaaaaaaaaaatcagctcatgttactcccctgctcaaaaatctccagcagctttctactacacttaaaataaaaaaaagtcagatgcagctgagtgcagtggctcacacctgtaatcccagcactttgggagactgaggtgggaggatcgcttgagcctaggagttcaagaccagcctgggcaacatagcaaaactcccgt

SEQ ID NO: 72253 - DNA, 679 bp, Homo sapiens
  misc_feature (104)..(104): n is a, c, g, or t
  misc_feature (117)..(118): n is a, c, g, or t
agaacaaaaaagccagttaaacttattcctttttttaaatagcaatctggaatgaaaatatcagatgagcataatataagagttagaagtcaagagagatgganaaatgaaagcaanngtcaagttcttgtcttggggggacaagtttatgtaccaattagctcaaggctttggtaaaataaatgtttaaatatgtaaaattttaagggcaacaaaaaacaatgtaggacatccaaaccactaaagaagaagaatttaaaacataattaaattcaaaacaatccaaaaggaaagaatttatgaagaaaaaaataaatgtataataagatggaagtaataaacctaaatatttcaataatcaaaataataattaatggattaaatgccctaaagacactctcagattagaattttaaaaatccaagtaccaaataacttgtaagaaatacaccttcaaagttacccagaatgtaaggcattcaaaaaaaaaaggcaaatattaacccaaagaaataaagtatagcaatattaacagcaaatgaagtataattaaagcccaaaacccacaaacattaaacagagcaaaagaaaatatatttcagagtgttaaagatttagtccactaagaatttgttaacataaatgaaatttttatataaccaacaacacagcttttaac

SEQ ID NO: 72254 - DNA, 387 bp, Homo sapiens
tagagacagggttttgccatgttggctaggctggtctcgaactcctgacctcaggtgatttgccgcctcagcctcccaaagtgctgggatcacagacgtgagccaccgcacccagcctcagcttcttcatttaaatccactgattggaatcccaagcatctgcagagaaaagagaaaaagaagaaccacatttttttctgtgggtgtgttttttgatatccggggatcctgtaagaacccattgttaaattttcaagattttgaaattgctaagcacaataaatattaaatttatatacttaaataaattatattaaaatgtggcaataaatacttaaaacgtatcccttcctgattatgtcatgagattttactgttacctatgct

SEQ ID NO: 72255 - DNA, 403 bp, Homo sapiens
gcccagctaaatttttgtattttagtagagatggagtttcaccatgttgtccaggctggtctccaactccttacctcaggtgatccgcctgtctcagcctcccaaagtgctgggattacaggcatgagccaccgcgcccggccgagattccatctttaatgagaccatcctctaatcctccctctattacagtgattatcccaatctcttagaaatcctgaaataattagtctggggtcatcctggggcatttctattttttcacaagatcccctagtgattttaatgtgtagccagggtttagtacacccatctctttttaaattcaacagacataaggcacattattcaaatgttagctgaatattctggaaatccccagaagagagcctaaatttgtaca

SEQ ID NO: 72256 - DNA, 776 bp, Homo sapiens
  misc_feature (125)..(125): n is a, c, g, or t
  misc_feature (201)..(201): n is a, c, g, or t
  misc_feature (209)..(209): n is a, c, g, or t
  misc_feature (219)..(219): n is a, c, g, or t
agtacggatgtgagaggagctagaatcagactggatctctgccacttttcccttcctacctcttaacttgcaggaaacaatgtgtctcttccgacagtgtctccagtgttcacagaatcaactgnaagttttgtttgctcatctagatatactggtcttccattagttcctagtagcagcaatggggccaacagccctgcnctctgttnccctcccagnttagcttacagtgctacaggaccatgatttctggggttggattggtgctgccccaggacacactccagttgccgtaccagtggcacttctctgggttcttcacatggcaccatcatccagaatactcccccagataaagcaacttcgggagtagtgtttcagagaaggactcatgatttccaggagtcaaaagccctcagtccaccaacagaactatgccagttggtcttcatctccaagataaaagatgaggtcagggatgggcatggtgcataactctgagccctgagtgagagaactgaggcagctgcaacttcacaaggtcaaggcccgacctccgcccatccccaccagcccaaagacttgccacctcagtgcccgagcatcctctggtgacctccctcaccagcccaacttaatctcaccagtgaaaacagaggtgaggcgagagtacccagcctgaagatgcttcttctatcagcctgcagaaatgttacactttcccttcaggcatccattaataaaagaaattgccatgcttactgccaggaaaagga

SEQ ID NO: 72257 - DNA, 3984 bp, Homo sapiens
cgaaggtctgcagcttcactcctgagccagcaagaccacgaaccaaccagaaggaagaaactccgaacacatctgaacatcagaaggaacaaactccggacacgccgcctttaagaactgtaacactcaccgggagggtccgcagcttcattcttgaagtcagtgagacgaagaacccaccaattccggacacactgatttcacattcacaaaaatagaacttttacctcccgctgatcccactgacgcattctggtggcttcatgcatctggcagccttcagcaccaccatggcccccctctcagcatgagaatctcgtggaacagtgtcatagctgcaaagtggaattctatcctcaaatttcataggaaatagtcgaactgtacaatgaaagattatgcaaatcttcaaggagcatctaatcaatcaccgcggtgtgagcggaatgcagcccatcgctgaattagcttctgttggaatgtattcatgtgtaacatcccactgactggatgacatcacaacagctccaggtccttgaaagtcttgaggatgattagctgaaggaattggctgtttctgccaatcataatccggcaaagctgcctttatagttctggagatgtgagagagagggagggagggaaagaccgactacagctaaacaagaggcacagcagcactagcaacagcagagcaggagcagctggtattccggtgattaaatagttctcatagcctttttgctgtactcggtctgctccctggtgtaattctcgtgtccaagaaggaagctgcattttaacggtgtgctgaacagaggtttgaatcattccagctggctgcttgttttgaaaaggacaatgtgtgtataaataaaaggactctgctggaagagttcagacactaagactggagctagagagtgctcttggaatattgttgaggcagattgcatgaactgaaagctccttctaattaacctggagccaagtgaacctgaatactggatatctcatgttctaacacgggataaattcaagttagaaaaagacaaaatattgaaatgcttctctagattatgcttagaggattctgcagcaattctcagtattggacatattcaaaatctcctcaacgtatatccttcccatctattgccttccagctttaactcagttgtgctcccttcaaacattttacatgatttgcgatggttacatgaactctggggaagtgatatttgcaacatctcatactttattcactatggcactttaggaaacgaaattgggaaaaagcttccaaaacattattctaaaaaatgaatcttattgtgaaacttcggagaagttttcgaacattgattgttctcttagctaccttttgcttggtgagcattgtcatttctgcctattttctctactctggctacaaacaggaaatgacacttattgaaaccactgcagaagcagaatgcactgacatcaaaattctaccatataggtcaatggagctgaaaacagttaaacctattgacacatccaaaacggaccctactgtccttctcttcgtggagagccaatactctcaactcggtcaagatatcatagctattttggagtccagccgatttcagtaccacatggttattgcccctggaaagggagatatacctcctcttacagataatggcaaagggaaatatactttagttatttatgaaaatattctgaagtatgtcagcatggactcatggaatcgagagcttttagaaaaatactgtgtggaatacagtgttagtataatcggttttcataaagccaatgagaacagcttaccaagtacacaattaaaaggctttccgttaaaccttttcaataatctagctctaaaggactgttttgttaaccctcaatctcctttgctgcatattaccaaagcccccaaggttgagaaaggccctcttcctggggaagactggactattttccaatataatcattcaacctaccagcctgtacttttaactgagttacagacagaaaaatccctgtcatccttgtctagcaaaacactctttgcaacggtgattcaggatctggggcttcatgatggaattcagagagtactttttggcaacaacttgaacttttggctgcacaagctcatcttcatagatgccatctccttcttgtcagggaagaggctgacattgtccttggacaggtacatccttgtggacattgatgatatatttgttgggaaagagggaacaaggatgaatgtcaaagatgtgaaggcattactagagactcaaaatttactgcgcactcaggttgcaaattttaccttcaaccttggattttcagggaagttttaccacacagggactgaagaggaagatgaaggagatgaccttttacttcggtctgtggatgagttctggtggtttcctcacatgtggagccacatgcagccccacctcttccacaacgagtcatctttagtagagcagatgattctcaacaaggaatttgcactggaacatggaataccaatcaacatgggctatgctgtggccccacatcactcaggggtctacccggttcacattcagctgtatgcagcttggaagaaggtctggggtattcaagtcaccagcactgaagaatatccacatctgaaacctgcccggtacagaaagggcttcattcacaatagcatcatggtcctccctcgacagacttgtgggttgttcactcacactattttctacaaagaatatccaggaggaccccaagaactggataaaagtatcagaggaggtgaactttttctcacaatccttctaaacccaatcagcattttcatgacccatttatcaaactatggaaatgaccgcctagggttatatacctttgtgaacttggtcaactttgtgcagagctggaccaacctgaaattgcaaactctgcctccagtgcaactggcccaccagtattttgagctcttccctgagcagaaagaccctctatggcagaatccatgtgatgataaacgacacaaagacatctggtccagagagaaaacttgtgaccacttaccaaaatttctagtaattggtccacaaaaaacaggaacaactgcactttatttatttcttcttatgcatccttcaatcatcagcaatctccctagtccaaagacatttgaggaagttcagttctttaatggcaacaactatcacaaaggaatagactggtatatggactttttccctacaccatccaatactacaagtgactttctgtttgaaaagagtgctaattacttccattcggaagaagctccaagacgagccgcatctcttgtccccaaagccaagatcatcaccatcctcattgacccctcagacagggcatactcttggtaccagcaccaacgatcacatgaagatccagctgctctgaggttcaatttctatgaagttatttcaacaggacattgggctccatctgacttaaaaactttgcagagaagatgcctagtacctggatggtatgcagtccacatagaaagatggctaacttactttgctacttctcagttgctaattattgatggacagcagctgagatctgacccagctactgtgatggatgaagtccagaagtttctgggagttacacctcgttataattactctgaagcactaacgtttgatccccaaaagggtttttggtgtcaattactggaaggaggaaagacaaaatgccttggaaaaagcaaaggccgaaaatatccacctatggatccagagtctagaacgttcctctctaattactaccgagatcataatgtggaactatccaaactgctacacagactgggacagcctctgccatcgtggctgagacaggaactgcagaaagtgagatagcactggagacaagaactaagcctctcaagatacttttagtgct

SEQ ID NO: 72258 - DNA, 407 bp, Homo sapiens
cgaaggtctgcagcttcactcctgagccagcaagaccacgaaccaaccagaaggaagaaactccgaacacatctgaacatcagaaggaacaaactccggacacgccgcctttaagaactgtaacactcaccgggagggtccgcagcttcattcttgaagtcagtgagacgaagaacccaccaattccggacacactgatttcacattcacaaaaatagaacttttacctcccgctgatcccactgacgcattctggtggcttcatgcatctggcagccttcagcaccaccatggcccccctctcagcatgaggtatgtccttgactacaagtatccaagtactttccttatatcaacaactatcctgaatgctgaggtggaaagacaggtgggagttcagactgaaa

SEQ ID NO: 72259 - DNA, 1900 bp, Homo sapiens
cgaaggtctgcagcttcactcctgagccagcaagaccacgaaccaaccagaaggaagaaactccgaacacatctgaacatcagaaggaacaaactccggacacgccgcctttaagaactgtaacactcaccgggagggtccgcagcttcattcttgaagtcagtgagacgaagaacccaccaattccggacacactgatttcacattcacaaaaatagaacttttacctcccgctgatcccactgacgcattctggtggcttcatgcatctggcagccttcagcaccaccatggcccccctctcagcatgagaatctcgtggaacagtgtcatagctgcaaagtggaattctatcctcaaatttcataggaaatagtcgaactgtacaatgaaagattatgcaaatcttcaaggagcatctaatcaatcaccgcggtgtgagcggaatgcagcccatcgctgaattagcttctgttggaatgtattcatgtgtaacatcccactgactggatgacatcacaacagctccaggtccttgaaagtcttgaggatgattagctgaaggaattggctgtttctgccaatcataatccggcaaagctgcctttatagttctggagatgtgagagagagggagggagggaaagaccgactacagctaaacaagaggcacagcagcactagcaacagcagagcaggagcagctggtattccggtgattaaatagttctcatagcctttttgctgtactcggtctgctccctggtgtaattctcgtgtccaagaaggaagctgcattttaacggtgtgctgaacagaggtttgaatcattccagctggctgcttgttttgaaaaggacaatgtgtgtataaataaaaggactctgctggaagagttcagacactaagactggagctagagagtgctcttggaatattgttgaggcagattgcatgaactgaaagctccttctaattaacctggagccaagtgaacctgaatactggatatctcatgttctaacacgggataaattcaagttagaaaaagacaaaatattgaaatgcttctctaggcattactagagactcaaaatttactgcgcactcaggttgcaaattttaccttcaaccttggattttcagggaagttttaccacacagggactgaagaggaagatgaaggagatgaccttttacttcggtctgtggatgagttctggtggtttcctcacatgtggagccacatgcagccccacctcttccacaacgagtcatctttagtagagcagatgattctcaacaaggaatttgcactgagatgcggagaggagaaatgccgtggactgccatttccaaggagaaatcataagcctagacttgacactacagagagatgtagccctatgttcttggctacacttacccaaggaacatggaataccaatcaacatgggctatgctgtggccccacatcactcaggggtctacccggttcacattcagctgtatgcagcttggaagaaggtctggggtattcaagtcaccagcactgaagaatatccacatctgaaacctgcccggtacagaaagggcttcattcacaatagcatcatggtcctccctcgacagacttgtgggttgttcactcacactattttctacaaagaatatccaggaggaccccaagaactggataaaagtatcagaggaggtgaactttttctcacaatccttctaaacccagtatgtattctatgtatgcaccttacaataagattagcatttttaaatgtgttttattttcctgtcttttaaactaaatcatatttattttctttatttacagcacatcttactggtcatgcatttaaatctatattaaaatacttttcttgat

SEQ ID NO: 72260 - DNA, 10756 bp, Homo sapiens
  misc_feature (7485)..(7485): n is a, c, g, or t
  misc_feature (8249)..(8249): n is a, c, g, or t
gcggggggaggggaggggaggggagggggcgcggggccgcggcagcggagctcgcatcctcggcggggcggctgtgcaggaggcggcgcccgggcgtcagcggacggaccgatcgacggccaagggcgcgcggaccgacggcggctgcccggaggggatcgcgggcctcggagacagcgactgcggacgatgcgcggccccaggccccgcgcgagcgggcgctgcccggggggctgaccgcggccggacggcgccccagcaccgggcgagggagcccgcgtcgcgcggaggtcagggagcctgagctggagccagggccccagtgggacctgacccaaagtctgaggtcaagctgggcccagagcctggcctggagctggagcccaaggcacagctggactacccttgtcatgcagaaggagctgggcattgtgccttcctgccctggcatgaagagccccaggccccacctcctgctaccattgctgctgctgctgctgctgctgctgggggctggggtgccaggtgcctggggtcaggctgggagcctggacttgcagattgatgaggagcagccagcgggtacactgattggcgacatcagtgcggggcttccggcaggcacggcagctcctctcatgtacttcatctctgcccaagagggcagcggcgtgggcacagacctggccattgacgaacacagtggggtcgtccgtacagcccgtgtcttggaccgtgagcagcgggaccgctaccgcttcactgcagtcactcctgatggtgccaccgtagaagttacagtgcgagtggctgacatcaacgaccatgctccagccttcccacaggctcgggctgccctgcaggtacctgagcatacagcttttggcacccgctacccactggagcctgctcgtgatgcagatgctgggcgtctgggaacccagggctatgcgctatctggtgatggggctggagagaccttccggctggagacacgccccggtccagatgggactccagtacctgagctggtagttactggggaactggaccgagagaaccgctcacactatatgctacagctggaggcctatgatggtggttcacccccccggagggcccaggccctgctggacgtgacactgctggacatcaatgaccatgccccggctttcaatcagagccgctaccatgctgtggtgtctgagagcctggcccctggcagtcctgtcttgcaggtgttcgcatctgatgccgatgctggtgtcaatggggctgtgacttacgagatcaaccggaggcagagcgagggtgatggacccttctccatcgacgcacacacggggctgctgcagttagagcggccactggactttgagcagcggcgggtccatgaactggtggtgcaagcacgagatggtggggctcaccctgagctgggctcggcctttgtgactgtgcatgtgcgagatgccaatgacaatcagccctccatgactgtcatctttctcagtgcagatggctccccccaagtgtctgaggccgccccacctggacagctcgttgctcgcatctctgtgtcagacccagatgatggtgactttgcccatgtcaatgtgtccctggaaggtggagagggccactttgccctaagcacccaagacagcgtcatctatctggtgtgtgtggctcggcggctggatcgagaggagagggatgcctataacttgagggttacagccacagactcaggctcacctccactgcgggctgaggctgcctttgtgctgcacgtcactgatgtcaacgacaatgcacctgcctttgaccgccagctctaccgacctgagcccctgcctgaggttgcgctgcctggcagctttgtagtgcgggtgactgctcgggatcctgaccaaggcaccaatggtcaggtcacttatagcctagcccctggcgcccacacccactggttctccattgaccccacctcaggcattatcactacggctgcctcactggactatgagttggaacctcagccacagctgattgtggtggccacagatggtggcctgccccctctagcctcctctgccacagttagcgtggccctgcaagatgtgaatgataatgagccccaattccagaggactttctacaatgcctcactgcctgagggcacccagcctggaacttgcttcctgcaggtgacagccacagacgcggatagtggcccatttggcctcctctcctattccttgggtgctggacttgggtcctccggatctcccccattccgcattgatgcccatagcggtgatgtgtgcacaacccggaccctggaccgtgaccaggggccctcaagctttgacttcacagtgacagctgtggatgggggaggcctcaagtccatggtatatgtgaaggtgtttctgtcagacgagaatgacaaccctcctcagttttatccacgggagtatgctgccagtataagtgcccagagtccaccaggcacagctgtgctgaggttgcgtgcccatgaccctgaccagggatcccatgggcgactctcctaccatatcctggctggcaacagccccccactttttaccttggatgagcaatcagggctgttgacagtagcctggcccttggccagacgggccaattctgtggtgcagctggagatcggggctgaggacggaggtggcctacaggcagaacccagtgcccgagtggacatcagcattgtgcctggaacccccacaccacccatatttgagcaactacagtatgttttttctgtgccagaggatgtggcaccaggcaccagtgtgggcatagtccaggcacacaacccaccaggtcgcttggcacctgtgaccctttccctatcaggtggggatccccgaggactcttctccctagatgcggtatcaggactgttgcaaacacttcgccctctggaccgggagctactgggaccagtgttggagctggaggtgcgagcaggcagtggagtgcccccagctttcgctgtagctcgggtgcgtgtgctgctggatgatgtgaatgacaactcccctgcctttcctgcacctgaagacacggtattgctaccaccaaacactgccccagggactcccatctatacactgcgggctcttgaccccgactcaggtgttaacagtcgagtcacctttaccctgcttgctgggggtggtggagccttcaccgtggaccccaccacaggccatgtacggcttatgaggcctctggggccctcaggagggccagcccatgagctggagctggaggcccgggatgggggctccccaccacgcaccagccactttcgactacgggtggtggtacaggatgtgggaacccgtgggctggctccccgattcaacagccctacctaccgtgtggacctgccctcaggcaccactgctggaactcaggtcctgcaagtgcaggcccaagcaccagatgggggccctatcacctatcaccttgcagcagagggagcaagtagcccctttggcctggagccacagagtgggtggctatgggtgcgggcagcactagaccgtgaggcccaggaattgtacatactgaaggtaatggcagtgtctgggtccaaagctgagttggggcagcagacaggcacagccaccgtgagggtcagcatcctcaaccagaatgaacacagtccccgcttgtctgaggatcccaccttcctggctgtggctgagaaccagcccccagggaccagcgtgggccgagtctttgccactgaccgagactcaggacccaatggacgtctgacctacagcctgcaacagctgtctgaagacagcaaggccttccgcatccacccccagactggagaagtgaccacactccaaaccctggaccgtgagcagcagagcagctatcagctcctggtgcaggtgcaggatggagggagcccaccccgcagcaccacaggcactgtgcatgttgcagtgcttgacctcaacgacaacagccccacgttcctgcaggcttcaggagctgctggtgggggcctccctatacaggtaccagaccgcgtgcctccaggaacactggtgacgactctgcaggcgaaggatccagatgagggggagaatgggaccatcttgtacacgctaactggtcctggctcagagcttttctctctgcaccctcactcaggggagctgctcactgcagctcccctgatccgagcagagcggccccactatgtgctgacactgagtgctcatgaccaaggcagccctcctcgaagtgccagcctccagctgctggtgcaggtgcttccctcagctcgcttggccgagccgcccccagatctcgcagagcgggacccagcggcaccagtgcctgtcgtgctgacggtgacagcagctgagggactgcggcccggctctctgttgggctcggtggcagcgccagagcccgcgggtgtgggtgcactcacctacacactggtgggcggtgccgatcccgagggcaccttcgcgctggatgcggcctcagggcgcttgtacctggcgcggcccctggacttcgaagctggcccgccgtggcgcgcgctcacggtacgcgctgaggggccgggaggcgcgggcgcgcggctgctgcgagtgcaggtgcaagtgcaggacgagaatgagcatgcgcccgcctttgcgcgcgacccgctggcgctggcgctgccagagaacccggagcccggcgcagcgctgtacactttccgcgcgtcggacgccgacggccccggccccaatagcgacgtgcgctaccgcctgctgcgccaggagccgcccgtgccggcgcttcgcctggacgcgcgcaccggggcgctcagcgctccgcgcggcctggaccgagagaccactcccgcgctgctgctgctggtggaagccaccgaccggcccgccaacgccagccgccgtcgtgcagcgcgcgtttcagcgcgcgtcttcgtcacggatgagaatgacaacgcgcctgtcttcgcctcgccgtcacgcgtgcgcctcccagaggaccagccgcctgggcccgcggccctgcacgtggtagcccgggacccggatctgggcgaggctgcacgcgtgtcctatcggctggcatctggcggggacggccacttccggctgcactcaagcactggagcgctgtccgtggtgcggccgttggaccgcgaacaacgagctgagcacgtactgacagtggtggcctcagaccacggctccccgccgcgctcggccacgcaggtcctgaccgtcagtgtcgctgacgtcaacgacgaggcgcctactttccagcagcaggagtacagcgtcctcttgcgtgagaacaaccctcctggcacatctctgctcaccctgcgagcaaccgaccccgacgtgggggccaacgggcaagtgacttatggaggcgtctctagcgaaagcttttctctggatcctgacactggtgttctcacgactcttcgggccctggatcgagaggaacaggaggagatcaacctgacagtgtatgcccaggacaggggctcacctcctcagttaacgcatgtcactgttcgagtggctgtggaggatgagaatgaccatgcaccaacctttgggagtgcccatctctctctggaggtgcctgagggccaggacccccagacccttaccatgcttcgggcctctgatccagatgtgggagccaatgggcagttgcagtaccgcatcctagatggggacccatcaggagcctttgtcctagaccttgcttctggagagtttggcaccatgcggccactagacagagaagtggagccagctttccagctgaggatagaggcccgggatggaggccagccagctctcagtgccacgctgcttttgacagtgacagtgctggatgccaatgaccatgctccagcctttcctgtgcctgcctactcggtggaggtgccggaggatgtgcctgcagggaccctgctgctgcagctacaggctcatgaccctgatgctggagctaatggccatgtgacctactacctgggcgccggtacagcaggagccttcctgctggagcccagctctggagaactgcgcacagctgcagccttggacagagaacagtgtcccagctacaccttttctgtgagtgcagtggatggtgcagctgctgggcccctaagcaccacagtgtctgtcaccatcacggtgcgcgatgtcaatgaccatgcacccaccttccccaccagtcctctgcgcctacgtctgccccgcccaggccccagcttcagtaccccaaccctggctctggccacactgagagctgaagatcgtgatgctggtgccaatgcttccattctgtaccggctggcaggcacaccacctcctggcactactgtggactcttacactggtgaaatccgcgtggcccgctctcctgtagctctaggcccccgagatcgtgtcctcttcattgtggccactgatcttggccgtccagctcgctctgccactggtgtgatcattgttggactgcagggggaagctgagcgtggaccccgctttccccgggctagcagtgaggctacgattcgtgagaatgcgcccccagggactcctattgtctcccccagggccgtccatgcaggaggcacaaatggacccatcacctacagcattctcagtgggaatgagaaagggacattctccatccagcctagtacaggtgccatcacagttcgctcagcagaggggctagacttcgaggtgagtccacggctgcgactggtgctgcaggcagagagtggaggagcctttgccttcactgtgctgaccctgaccctgcaagatgccaacgacaatgctccccgtttcctgcggccccattatgtggccttccttcctgagtcccggcccttggaggggcccctgctgcaggtggaggcggatgacctggatcaaggctctggaggacagatttcctacagtctggctgcatcccagccggcacgtggattgttccacgtagacccaaccacaggcactatcactaccacagccatcctggaccgtgagatctgggctgaaacacggttggtgctgatggccacagacagagggagcccagccctggtgggctcagctaccttgacggtgatggtcatcgacaccaatgacaatcgccccaccatcccccaaccctgggagctccgagtgtcagaagatgcgttattgggctcagagattgcacaggtaacagggaatgatgtggactcaggacccgtgctgtggtatgtgctaagcccatctgggccccaggatcccttcagtgttggccgctatggaggccgtgtctccctcacggggcccctggactttgagcagtgtgaccgctaccagctgcagctgctggcacatgatgggcctcatgagggcngtgccaacctcacagtgcttgtggaggatgtcaatgacaatgcacctgccttctcacagagcctctaccaggtaatgctgcttgagcacacacccccaggcagtgccattctctccgtctctgccactgatcgggactcaggtgccaacggtcacatttcctaccacctggcttcccctgccgatggcttcagtgttgaccccaacaatgggaccctgttcacaatagtgggaacagtggccttgggccatgacgggtcaggagcagtggatgtggtgctggaagcacgagaccacggggctccaggccgggcagcacgagccacagtgcacgtgcagctgcaggaccagaacgaccacgccccgagcttcacattgtcacactaccgtgtggctgtgactgaagacctgccccctggctccactctgctcaccctggaggctacagatgctgatggaagccgcagccatgccgctgtggactacagcatcatcagtggcaactggggccgagtcttccagctggaacccaggctggctgaggctggggagagtgctggaccaggcccccgggcactgggctgcctggtgttgcttgaacctctagactttgaaagcctgacacagtacaatctaacagtggctgcagctgaccgtgggcagccaccccaaagctcagtcgtgccagtcactgtcactgtactagatgtcaatgacaacccacctgtctttacccgagcatcctaccgtgtgacagtacctgangacacacctgttggagctgagctgctgcatgtagaggcctctgacgctgaccctggccctcatggcctcgtgcgtttcactgtcagctcaggcgacccatcagggctctttgagctggatgagagctcaggcaccttgcgactggcccatgccctggactgtgagacccaggctcgacatcagcttgtagtacaggctgctgaccctgctggtgcacactttgctttggcaccagtgacaattgaggtccaggatgtgaatgatcatggcccagccttcccactgaacttactcagcaccagcgtggccgagaatcagcctccaggcactctcgtgaccactctgcatgcaatcgacggggatgctggggcttttgggaggctccgttacagcctgttggaggctgggccaggacctgagggccgtgaggcatttgcactgaacagctcaacaggggagttgcgtgcgcgagtgccctttgactatgagcacacagaaagcttccggctgctggtgggtgctgctgatgctgggaatctctcagcctctgtcactgtgtcggtgctagtgactggagaggatgagtatgaccctgtatttctggcaccagctttccacttccaagtgcccgaaggtgcccggcgtggccacagcttgggtcacgtgcaggccacagatgaggatgggggtgccgatggcctggttctgtattcccttgccacctcttccccctattttggtattaaccagactacaggagccctgtacctgcgggtggacagtcgggcaccaggcagcggaacagccacctctgggggtgggggccggacccggcgggaagcaccacgggagctgaggctggaggtgatagcacgggggcctctgcctggttcccggagtgccacagtgcctgtgaccgtggatatcacccacaccgcactgggcctggcacctgacctcaacctgctattagtaggggccgtggcagcctccttgggagttgtggtggtgcttgcactggcagccctggtcctaggacttgttcgggcccgtagccgcaaggctgaggcagcccctggcccaatgtcacaggcagcacccctagccagtgactcactgcagaaactgggccgggagccacctagtccaccaccctctgagcacctctatcaccagactcttcccagctatggtgggccaggagctggaggaccctacccccgtggtggctccttggacccttcacattcaagtggccgaggatcagcagaggctgcagaggatgatgagatccgcatgatcaatgagttcccccgtgtggccagtgtggcctcctctctggctgcccgtggccctgactcaggcatccagcaggatgcagatggtctgagtgacacatcctgcgaaccacctgcccctgacacctggtataagggccgaaaggcagggctgctgctgccaggtgcaggagccactctctacagagaggaggggcccccagccactgccacagccttcctggggggctgtggcctgagccctgcacccactggggactatggcttcccagcagatggcaagccatgtgtggcaggtgcgctgacagccattgtggccggcgaggaggagctccgtggcagctataactgggactacctgctgagctggtgccctcagttccaaccactggccagtgtcttcacagagatcgctcggctcaaggatgaagctcggccatgtcccccagctccccgtatcgacccaccacccctcatcactgccgtggcccacccaggagccaagtctgtgccccccaagccagcaaacacagctgcagcccgggccatcttcccaccagcttctcaccgctcccccatcagccatgaaggctccctgtcctcagctgccatgtcccccagcttctcaccctctctgtctcctctggctgctcgctcacccgttgtctcaccatttggggtggcccagggtccctcagcctcagcactcagcgcagagtctggcctggagccacctgatgacacggagctgcacatctagctgtggcccaggctgggccccgacctgggatgcgcacagtgtccccaacgcaggccccactctgagcctgccctgggcagcctcggactatgactggctacggggaggccaccaccaggccccagctctccaccctgaactccccagccccctcagagtactaggaccacagaagccctgttgctcactgacctgtgaccaggtccaatgtggggagaaatatgaaggaggtagcagccctgggttctcctcagtgagggatccctgccctgcaccagcaccctgagatggagctgagactttatttattgggggtagggggatggaggaggtccctccaacatgtttggacccagctcctttgggttccactgacacccctgcccctgcccctgcccagaaccaagtgccatttctcactctggagccttaataaactgcaatttgta

SEQ ID NO: 72261 - DNA, 10777 bp, Homo sapiens
  misc_feature (7364)..(7364): n is a, c, g, or t
  misc_feature (8128)..(8128): n is a, c, g, or t
gcggggggaggggaggggaggggagggggcgcggggccgcggcagcggagctcgcatcctcggcggggcggctgtgcaggaggcggcgcccgggcgtcagcggacggaccgatcgacggccaagggcgcgcggaccgacggcggctgcccggaggggatcgcgggcctcggagacagcgactgcggacgatgcgcggccccaggccccgcgcgagcgggcgctgcccggggggctgaccgcggccggacggcgccccagcaccgggcgagggagcccgcgtcgcgcggaggtcagggagcctgagctggagccagggccccagtgggacctgacccaaagtctgaggtcaagctgggcccagagcctggcctggagctggagcccaaggcacagctggactacccttgtcatgcagaaggagctgggcattgtgccttcctgccctggcatgaagagccccaggccccacctcctgctaccattgctgctgctgctgctgctgctgctgggggctggggtgccaggtgcctggggtcaggctgggagcctggacttgcagattgatgaggagcagccagcgggtacactgattggcgacatcagtgcggggcttccggcaggcacggcagctcctctcatgtacttcatctctgcccaagagggcagcggcgtgggcacagacctggccattgacgaacacagtggggtcgtccgtacagcccgtgtcttggaccgtgagcagcgggaccgctaccgcttcactgcagtcactcctgatggtgccaccgtagaagttacagtgcgagtggctgacatcaacgaccatgctccagccttcccacaggctcgggctgccctgcaggtacctgagcatacagcttttggcacccgctacccactggagcctgctcgtgatgcagatgctgggcgtctgggaacccagggctatgcgctatctggtgatggggctggagagaccttccggctggagacacgccccggtccagatgggactccagtacctgagctggtagttactggggaactggaccgagagaaccgctcacactatatgctacagctggaggcctatgatggtggttcacccccccggagggcccaggccctgctggacgtgacactgctggacatcaatgaccatgccccggctttcaatcagagccgctaccatgctgtggtgtctgagagcctggcccctggcagtcctgtcttgcaggtgttcgcatctgatgccgatgctggtgtcaatggggctgtgacttacgagatcaaccggaggcagagcgagggtgatggacccttctccatcgacgcacacacggggctgctgcagttagagcggccactggactttgagcagcggcgggtccatgaactggtggtgcaagcacgagatggtggggctcaccctgagctgggctcggcctttgtgactgtgcatgtgcgagatgccaatgacaatcagccctccatgactgtcatctttctcagtgcagatggctccccccaagtgtctgaggccgccccacctggacagctcgttgctcgcatctctgtgtcagacccagatgatggtgactttgcccatgtcaatgtgtccctggaaggtggagagggccactttgccctaagcacccaagacagcgtcatctatctggtgtgtgtggctcggcggctggatcgagaggagagggatgcctataacttgagggttacagccacagactcaggctcacctccactgcgggctgaggctgcctttgtgctgcacgtcactgatgtcaacgacaatgcacctgcctttgaccgccagctctaccgacctgagcccctgcctgaggttgcgctgcctggcagctttgtagtgcgggtgactgctcgggatcctgaccaaggcaccaatggtcaggtcacttatagcctagcccctggcgcccacacccactggttctccattgaccccacctcaggcattatcactacggctgcctcactggactatgagttggaacctcagccacagctgattgtggtggccacagatggtggcctgccccctctagcctcctctgccacagttagcgtggccctgcaagatgtgaatgataatgagccccaattccagaggactttctacaatgcctcactgcctgagggcacccagcctggaacttgcttcctgcaggtgacagccacagacgcggatagtggcccatttggcctcctctcctattccttgggtgctggacttgggtcctccggatctcccccattccgcattgatgcccatagcggtgatgtgtgcacaacccggaccctggaccgtgaccaggggccctcaagctttgacttcacagtgacagctgtggatgggggaggcctcaagtccatggtatatgtgaaggtgtttctgtcagacgagaatgacaaccctcctcagttttatccacgggagtatgctgccagtataagtgcccagagtccaccaggcacagctgtgctgaggttgcgtgcccatgaccctgaccagggatcccatgggcgactctcctaccatatcctggctggcaacagccccccactttttaccttggatgagcaatcagggctgttgacagtagcctggcccttggccagacgggccaattctgtggtgcagctggagatcggggctgaggacggaggtggcctacaggcagaacccagtgcccgagtggacatcagcattgtgcctggaacccccacaccacccatatttgagcaactacagtatgttttttctgtgccagaggatgtggcaccaggcaccagtgtgggcatagtccaggcacacaacccaccaggtcgcttggcacctgtgaccctttccctatcaggtggggatccccgaggactcttctccctagatgcggtatcaggactgttgcaaacacttcgccctctggaccgggagctactgggaccagtgttggagctggaggtgcgagcaggcagtggagtgcccccagctttcgctgtagctcgggtgcgtgtgctgctggatgatgtgaatgacaactcccctgcctttcctgcacctgaagacacggtattgctaccaccaaacactgccccagggactcccatctatacactgcgggctcttgaccccgactcaggtgttaacagtcgagtcacctttaccctgcttgctgggggtggtggagccttcaccgtggaccccaccacaggccatgtacggcttatgaggccttggctccccgattcaacagccctacctaccgtgtggacctgccctcaggcaccactgctggaactcaggtcctgcaagtgcaggcccaagcaccagatgggggccctatcacctatcaccttgcagcagagggagcaagtagcccctttggcctggagccacagagtgggtggctatgggtgcgggcagcactagaccgtgaggcccaggaattgtacatactgaaggtaatggcagtgtctgggtccaaagctgagttggggcagcagacaggcacagccaccgtgagggtcagcatcctcaaccagaatgaacacagtccccgcttgtctgaggatcccaccttcctggctgtggctgagaaccagcccccagggaccagcgtgggccgagtctttgccactgaccgagactcaggacccaatggacgtctgacctacagcctgcaacagctgtctgaagacagcaaggccttccgcatccacccccagactggagaagtgaccacactccaaaccctggaccgtgagcagcagagcagctatcagctcctggtgcaggtgcaggatggagggagcccaccccgcagcaccacaggcactgtgcatgttgcagtgcttgacctcaacgacaacagccccacgttcctgcaggcttcaggagctgctggtgggggcctccctatacaggtaccagaccgcgtgcctccaggaacactggtgacgactctgcaggcgaaggatccagatgagggggagaatgggaccatcttgtacacgctaactggtcctggctcagagcttttctctctgcaccctcactcaggggagctgctcactgcagctcccctgatccgagcagagcggccccactatgtgctgacactgagtgctcatgaccaaggcagccctcctcgaagtgccagcctccagctgctggtgcaggtgcttccctcagctcgcttggccgagccgcccccagatctcgcagagcgggacccagcggcaccagtgcctgtcgtgctgacggtgacagcagctgagggactgcggcccggctctctgttgggctcggtggcagcgccagagcccgcgggtgtgggtgcactcacctacacactggtgggcggtgccgatcccgagggcaccttcgcgctggatgcggcctcagggcgcttgtacctggcgcggcccctggacttcgaagctggcccgccgtggcgcgcgctcacggtacgcgctgaggggccgggaggcgcgggcgcgcggctgctgcgagtgcaggtgcaagtgcaggacgagaatgagcatgcgcccgcctttgcgcgcgacccgctggcgctggcgctgccagagaacccggagcccggcgcagcgctgtacactttccgcgcgtcggacgccgacggccccggccccaatagcgacgtgcgctaccgcctgctgcgccaggagccgcccgtgccggcgcttcgcctggacgcgcgcaccggggcgctcagcgctccgcgcggcctggaccgagagaccactcccgcgctgctgctgctggtggaagccaccgaccggcccgccaacgccagccgccgtcgtgcagcgcgcgtttcagcgcgcgtcttcgtcacggatgagaatgacaacgcgcctgtcttcgcctcgccgtcacgcgtgcgcctcccagaggaccagccgcctgggcccgcggccctgcacgtggtagcccgggacccggatctgggcgaggctgcacgcgtgtcctatcggctggcatctggcggggacggccacttccggctgcactcaagcactggagcgctgtccgtggtgcggccgttggaccgcgaacaacgagctgagcacgtactgacagtggtggcctcagaccacggctccccgccgcgctcggccacgcaggtcctgaccgtcagtgtcgctgacgtcaacgacgaggcgcctactttccagcagcaggagtacagcgtcctcttgcgtgagaacaaccctcctggcacatctctgctcaccctgcgagcaaccgaccccgacgtgggggccaacgggcaagtgacttatggaggcgtctctagcgaaagcttttctctggatcctgacactggtgttctcacgactcttcgggccctggatcgagaggaacaggaggagatcaacctgacagtgtatgcccaggacaggggctcacctcctcagttaacgcatgtcactgttcgagtggctgtggaggatgagaatgaccatgcaccaacctttgggagtgcccatctctctctggaggtgcctgagggccaggacccccagacccttaccatgcttcgggcctctgatccagatgtgggagccaatgggcagttgcagtaccgcatcctagatggggacccatcaggagcctttgtcctagaccttgcttctggagagtttggcaccatgcggccactagacagagaagtggagccagctttccagctgaggatagaggcccgggatggaggccagccagctctcagtgccacgctgcttttgacagtgacagtgctggatgccaatgaccatgctccagcctttcctgtgcctgcctactcggtggaggtgccggaggatgtgcctgcagggaccctgctgctgcagctacaggctcatgaccctgatgctggagctaatggccatgtgacctactacctgggcgccggtacagcaggagccttcctgctggagcccagctctggagaactgcgcacagctgcagccttggacagagaacagtgtcccagctacaccttttctgtgagtgcagtggatggtgcagctgctgggcccctaagcaccacagtgtctgtcaccatcacggtgcgcgatgtcaatgaccatgcacccaccttccccaccagtcctctgcgcctacgtctgccccgcccaggccccagcttcagtaccccaaccctggctctggccacactgagagctgaagatcgtgatgctggtgccaatgcttccattctgtaccggctggcaggcacaccacctcctggcactactgtggactcttacactggtgaaatccgcgtggcccgctctcctgtagctctaggcccccgagatcgtgtcctcttcattgtggccactgatcttggccgtccagctcgctctgccactggtgtgatcattgttggactgcagggggaagctgagcgtggaccccgctttccccgggctagcagtgaggctacgattcgtgagaatgcgcccccagggactcctattgtctcccccagggccgtccatgcaggaggcacaaatggacccatcacctacagcattctcagtgggaatgagaaagggacattctccatccagcctagtacaggtgccatcacagttcgctcagcagaggggctagacttcgaggtgagtccacggctgcgactggtgctgcaggcagagagtggaggagcctttgccttcactgtgctgaccctgaccctgcaagatgccaacgacaatgctccccgtttcctgcggccccattatgtggccttccttcctgagtcccggcccttggaggggcccctgctgcaggtggaggcggatgacctggatcaaggctctggaggacagatttcctacagtctggctgcatcccagccggcacgtggattgttccacgtagacccaaccacaggcactatcactaccacagccatcctggaccgtgagatctgggctgaaacacggttggtgctgatggccacagacagagggagcccagccctggtgggctcagctaccttgacggtgatggtcatcgacaccaatgacaatcgccccaccatcccccaaccctgggagctccgagtgtcagaagatgcgttattgggctcagagattgcacaggtaacagggaatgatgtggactcaggacccgtgctgtggtatgtgctaagcccatctgggccccaggatcccttcagtgttggccgctatggaggccgtgtctccctcacggggcccctggactttgagcagtgtgaccgctaccagctgcagctgctggcacatgatgggcctcatgagggcngtgccaacctcacagtgcttgtggaggatgtcaatgacaatgcacctgccttctcacagagcctctaccaggtaatgctgcttgagcacacacccccaggcagtgccattctctccgtctctgccactgatcgggactcaggtgccaacggtcacatttcctaccacctggcttcccctgccgatggcttcagtgttgaccccaacaatgggaccctgttcacaatagtgggaacagtggccttgggccatgacgggtcaggagcagtggatgtggtgctggaagcacgagaccacggggctccaggccgggcagcacgagccacagtgcacgtgcagctgcaggaccagaacgaccacgccccgagcttcacattgtcacactaccgtgtggctgtgactgaagacctgccccctggctccactctgctcaccctggaggctacagatgctgatggaagccgcagccatgccgctgtggactacagcatcatcagtggcaactggggccgagtcttccagctggaacccaggctggctgaggctggggagagtgctggaccaggcccccgggcactgggctgcctggtgttgcttgaacctctagactttgaaagcctgacacagtacaatctaacagtggctgcagctgaccgtgggcagccaccccaaagctcagtcgtgccagtcactgtcactgtactagatgtcaatgacaacccacctgtctttacccgagcatcctaccgtgtgacagtacctgangacacacctgttggagctgagctgctgcatgtagaggcctctgacgctgaccctggccctcatggcctcgtgcgtttcactgtcagctcaggcgacccatcagggctctttgagctggatgagagctcaggcaccttgcgactggcccatgccctggactgtgagacccaggctcgacatcagcttgtagtacaggctgctgaccctgctggtgcacactttgctttggcaccagtgacaattgaggtccaggatgtgaatgatcatggcccagccttcccactgaacttactcagcaccagcgtggccgagaatcagcctccaggcactctcgtgaccactctgcatgcaatcgacggggatgctggggcttttgggaggctccgttacagcctgttggaggctgggccaggacctgagggccgtgaggcatttgcactgaacagctcaacaggggagttgcgtgcgcgagtgccctttgactatgagcacacagaaagcttccggctgctggtgggtgctgctgatgctgggaatctctcagcctctgtcactgtgtcggtgctagtgactggagaggatgagtatgaccctgtatttctggcaccagctttccacttccaagtgcccgaaggtgcccggcgtggccacagcttgggtcacgtgcaggccacagatgaggatgggggtgccgatggcctggttctgtattcccttgccacctcttccccctattttggtattaaccagactacaggagccctgtacctgcgggtggacagtcgggcaccaggcagcggaacagccacctctgggggtgggggccggacccggcgggaagcaccacgggagctgaggctggaggtgatagcacgggggcctctgcctggttcccggagtgccacagtgcctgtgaccgtggatatcacccacaccgcactgggcctggcacctgacctcaacctgctattagtaggggccgtggcagcctccttgggagttgtggtggtgcttgcactggcagccctggtcctaggacttgttcgggcccgtagccgcaaggctgaggcagcccctggcccaatgtcacaggcagcacccctagccagtgactcactgcagaaactgggccgggagccacctagtccaccaccctctgagcacctctatcaccagactcttcccagctatggtgggccaggagctggaggaccctacccccgtggtggctccttggacccttcacattcaagtggccgaggatcagcagaggctgcagaggatgatgagatccgcatgatcaatgagttcccccgtgtggccagtgtggcctcctctctggctgcccgtggccctgactcaggcatccagcaggatgcagatggtctgagtgacacatcctgcgaaccacctgcccctgacacctggtataagggccgaaaggcagggctgctgctgccaggtgcaggagccactctctacagagaggaggggcccccagccactgccacagccttcctggggggctgtggcctgagccctgcacccactggggactatggcttcccagcagatggcaagccatgtgtggcaggtgcgctgacagccattgtggccggcgaggaggagctccgtggcagctataactgggactacctgctgagctggtgccctcagttccaaccactggccagtgtcttcacagagatcgctcggctcaaggatgaagcgtggcccacccaggagccaagtctgtgccccccaagccagcaaacacagctgcagcccgggccatcttcccaccagcttctcaccgctcccccatcagccatgaaggctccctgtcctcagctgccatgtcccccagcttctcaccctctctgtctcctctggctgctcgctcacccgttgtctcaccatttggggtggcccagggtccctcagcctcagcactcagcgcagagtctggcctggagccacctgatgacacggagctgcacatctagctgtggcccaggctgggccccgacctgggatgcgcacagtgtccccaacgcaggccccactctgagcctgccctgggcagcctcggactatgactggctacggggaggccaccaccaggccccagctctccaccctgaactccccagccccctcagagtactaggaccacagaagccctgttgctcactgacctgtgaccaggtccaatgtggggagaaatatgaaggaggtagcagccctgggttctcctcagtgagggatccctgccctgcaccagcaccctgagatggagctgagactttatttattgggggtagggggatggaggaggtccctccaacatgtttggacccagctcctttgggttccactgacacccctgcccctgcccctgcccagaaccaagtgccatttctcactctggagccttaataaactgcaatttgtatccagtctccagctttgttctatagggatgactggaagacacctggcagagtattgtggatacctcaggaggcacagaggggtggtggggtggggatggcactgggagctcaggagcctagcctgaggctgatgatcacatctctctgcagctattcttttccctctaatatgggcaaagaggccagcagggcc

SEQ ID NO: 72262 - DNA, 10538 bp, Homo sapiens
  misc_feature (7364)..(7364): n is a, c, g, or t
  misc_feature (8128)..(8128): n is a, c, g, or t
gcggggggaggggaggggaggggagggggcgcggggccgcggcagcggagctcgcatcctcggcggggcggctgtgcaggaggcggcgcccgggcgtcagcggacggaccgatcgacggccaagggcgcgcggaccgacggcggctgcccggaggggatcgcgggcctcggagacagcgactgcggacgatgcgcggccccaggccccgcgcgagcgggcgctgcccggggggctgaccgcggccggacggcgccccagcaccgggcgagggagcccgcgtcgcgcggaggtcagggagcctgagctggagccagggccccagtgggacctgacccaaagtctgaggtcaagctgggcccagagcctggcctggagctggagcccaaggcacagctggactacccttgtcatgcagaaggagctgggcattgtgccttcctgccctggcatgaagagccccaggccccacctcctgctaccattgctgctgctgctgctgctgctgctgggggctggggtgccaggtgcctggggtcaggctgggagcctggacttgcagattgatgaggagcagccagcgggtacactgattggcgacatcagtgcggggcttccggcaggcacggcagctcctctcatgtacttcatctctgcccaagagggcagcggcgtgggcacagacctggccattgacgaacacagtggggtcgtccgtacagcccgtgtcttggaccgtgagcagcgggaccgctaccgcttcactgcagtcactcctgatggtgccaccgtagaagttacagtgcgagtggctgacatcaacgaccatgctccagccttcccacaggctcgggctgccctgcaggtacctgagcatacagcttttggcacccgctacccactggagcctgctcgtgatgcagatgctgggcgtctgggaacccagggctatgcgctatctggtgatggggctggagagaccttccggctggagacacgccccggtccagatgggactccagtacctgagctggtagttactggggaactggaccgagagaaccgctcacactatatgctacagctggaggcctatgatggtggttcacccccccggagggcccaggccctgctggacgtgacactgctggacatcaatgaccatgccccggctttcaatcagagccgctaccatgctgtggtgtctgagagcctggcccctggcagtcctgtcttgcaggtgttcgcatctgatgccgatgctggtgtcaatggggctgtgacttacgagatcaaccggaggcagagcgagggtgatggacccttctccatcgacgcacacacggggctgctgcagttagagcggccactggactttgagcagcggcgggtccatgaactggtggtgcaagcacgagatggtggggctcaccctgagctgggctcggcctttgtgactgtgcatgtgcgagatgccaatgacaatcagccctccatgactgtcatctttctcagtgcagatggctccccccaagtgtctgaggccgccccacctggacagctcgttgctcgcatctctgtgtcagacccagatgatggtgactttgcccatgtcaatgtgtccctggaaggtggagagggccactttgccctaagcacccaagacagcgtcatctatctggtgtgtgtggctcggcggctggatcgagaggagagggatgcctataacttgagggttacagccacagactcaggctcacctccactgcgggctgaggctgcctttgtgctgcacgtcactgatgtcaacgacaatgcacctgcctttgaccgccagctctaccgacctgagcccctgcctgaggttgcgctgcctggcagctttgtagtgcgggtgactgctcgggatcctgaccaaggcaccaatggtcaggtcacttatagcctagcccctggcgcccacacccactggttctccattgaccccacctcaggcattatcactacggctgcctcactggactatgagttggaacctcagccacagctgattgtggtggccacagatggtggcctgccccctctagcctcctctgccacagttagcgtggccctgcaagatgtgaatgataatgagccccaattccagaggactttctacaatgcctcactgcctgagggcacccagcctggaacttgcttcctgcaggtgacagccacagacgcggatagtggcccatttggcctcctctcctattccttgggtgctggacttgggtcctccggatctcccccattccgcattgatgcccatagcggtgatgtgtgcacaacccggaccctggaccgtgaccaggggccctcaagctttgacttcacagtgacagctgtggatgggggaggcctcaagtccatggtatatgtgaaggtgtttctgtcagacgagaatgacaaccctcctcagttttatccacgggagtatgctgccagtataagtgcccagagtccaccaggcacagctgtgctgaggttgcgtgcccatgaccctgaccagggatcccatgggcgactctcctaccatatcctggctggcaacagccccccactttttaccttggatgagcaatcagggctgttgacagtagcctggcccttggccagacgggccaattctgtggtgcagctggagatcggggctgaggacggaggtggcctacaggcagaacccagtgcccgagtggacatcagcattgtgcctggaacccccacaccacccatatttgagcaactacagtatgttttttctgtgccagaggatgtggcaccaggcaccagtgtgggcatagtccaggcacacaacccaccaggtcgcttggcacctgtgaccctttccctatcaggtggggatccccgaggactcttctccctagatgcggtatcaggactgttgcaaacacttcgccctctggaccgggagctactgggaccagtgttggagctggaggtgcgagcaggcagtggagtgcccccagctttcgctgtagctcgggtgcgtgtgctgctggatgatgtgaatgacaactcccctgcctttcctgcacctgaagacacggtattgctaccaccaaacactgccccagggactcccatctatacactgcgggctcttgaccccgactcaggtgttaacagtcgagtcacctttaccctgcttgctgggggtggtggagccttcaccgtggaccccaccacaggccatgtacggcttatgaggccttggctccccgattcaacagccctacctaccgtgtggacctgccctcaggcaccactgctggaactcaggtcctgcaagtgcaggcccaagcaccagatgggggccctatcacctatcaccttgcagcagagggagcaagtagcccctttggcctggagccacagagtgggtggctatgggtgcgggcagcactagaccgtgaggcccaggaattgtacatactgaaggtaatggcagtgtctgggtccaaagctgagttggggcagcagacaggcacagccaccgtgagggtcagcatcctcaaccagaatgaacacagtccccgcttgtctgaggatcccaccttcctggctgtggctgagaaccagcccccagggaccagcgtgggccgagtctttgccactgaccgagactcaggacccaatggacgtctgacctacagcctgcaacagctgtctgaagacagcaaggccttccgcatccacccccagactggagaagtgaccacactccaaaccctggaccgtgagcagcagagcagctatcagctcctggtgcaggtgcaggatggagggagcccaccccgcagcaccacaggcactgtgcatgttgcagtgcttgacctcaacgacaacagccccacgttcctgcaggcttcaggagctgctggtgggggcctccctatacaggtaccagaccgcgtgcctccaggaacactggtgacgactctgcaggcgaaggatccagatgagggggagaatgggaccatcttgtacacgctaactggtcctggctcagagcttttctctctgcaccctcactcaggggagctgctcactgcagctcccctgatccgagcagagcggccccactatgtgctgacactgagtgctcatgaccaaggcagccctcctcgaagtgccagcctccagctgctggtgcaggtgcttccctcagctcgcttggccgagccgcccccagatctcgcagagcgggacccagcggcaccagtgcctgtcgtgctgacggtgacagcagctgagggactgcggcccggctctctgttgggctcggtggcagcgccagagcccgcgggtgtgggtgcactcacctacacactggtgggcggtgccgatcccgagggcaccttcgcgctggatgcggcctcagggcgcttgtacctggcgcggcccctggacttcgaagctggcccgccgtggcgcgcgctcacggtacgcgctgaggggccgggaggcgcgggcgcgcggctgctgcgagtgcaggtgcaagtgcaggacgagaatgagcatgcgcccgcctttgcgcgcgacccgctggcgctggcgctgccagagaacccggagcccggcgcagcgctgtacactttccgcgcgtcggacgccgacggccccggccccaatagcgacgtgcgctaccgcctgctgcgccaggagccgcccgtgccggcgcttcgcctggacgcgcgcaccggggcgctcagcgctccgcgcggcctggaccgagagaccactcccgcgctgctgctgctggtggaagccaccgaccggcccgccaacgccagccgccgtcgtgcagcgcgcgtttcagcgcgcgtcttcgtcacggatgagaatgacaacgcgcctgtcttcgcctcgccgtcacgcgtgcgcctcccagaggaccagccgcctgggcccgcggccctgcacgtggtagcccgggacccggatctgggcgaggctgcacgcgtgtcctatcggctggcatctggcggggacggccacttccggctgcactcaagcactggagcgctgtccgtggtgcggccgttggaccgcgaacaacgagctgagcacgtactgacagtggtggcctcagaccacggctccccgccgcgctcggccacgcaggtcctgaccgtcagtgtcgctgacgtcaacgacgaggcgcctactttccagcagcaggagtacagcgtcctcttgcgtgagaacaaccctcctggcacatctctgctcaccctgcgagcaaccgaccccgacgtgggggccaacgggcaagtgacttatggaggcgtctctagcgaaagcttttctctggatcctgacactggtgttctcacgactcttcgggccctggatcgagaggaacaggaggagatcaacctgacagtgtatgcccaggacaggggctcacctcctcagttaacgcatgtcactgttcgagtggctgtggaggatgagaatgaccatgcaccaacctttgggagtgcccatctctctctggaggtgcctgagggccaggacccccagacccttaccatgcttcgggcctctgatccagatgtgggagccaatgggcagttgcagtaccgcatcctagatggggacccatcaggagcctttgtcctagaccttgcttctggagagtttggcaccatgcggccactagacagagaagtggagccagctttccagctgaggatagaggcccgggatggaggccagccagctctcagtgccacgctgcttttgacagtgacagtgctggatgccaatgaccatgctccagcctttcctgtgcctgcctactcggtggaggtgccggaggatgtgcctgcagggaccctgctgctgcagctacaggctcatgaccctgatgctggagctaatggccatgtgacctactacctgggcgccggtacagcaggagccttcctgctggagcccagctctggagaactgcgcacagctgcagccttggacagagaacagtgtcccagctacaccttttctgtgagtgcagtggatggtgcagctgctgggcccctaagcaccacagtgtctgtcaccatcacggtgcgcgatgtcaatgaccatgcacccaccttccccaccagtcctctgcgcctacgtctgccccgcccaggccccagcttcagtaccccaaccctggctctggccacactgagagctgaagatcgtgatgctggtgccaatgcttccattctgtaccggctggcaggcacaccacctcctggcactactgtggactcttacactggtgaaatccgcgtggcccgctctcctgtagctctaggcccccgagatcgtgtcctcttcattgtggccactgatcttggccgtccagctcgctctgccactggtgtgatcattgttggactgcagggggaagctgagcgtggaccccgctttccccgggctagcagtgaggctacgattcgtgagaatgcgcccccagggactcctattgtctcccccagggccgtccatgcaggaggcacaaatggacccatcacctacagcattctcagtgggaatgagaaagggacattctccatccagcctagtacaggtgccatcacagttcgctcagcagaggggctagacttcgaggtgagtccacggctgcgactggtgctgcaggcagagagtggaggagcctttgccttcactgtgctgaccctgaccctgcaagatgccaacgacaatgctccccgtttcctgcggccccattatgtggccttccttcctgagtcccggcccttggaggggcccctgctgcaggtggaggcggatgacctggatcaaggctctggaggacagatttcctacagtctggctgcatcccagccggcacgtggattgttccacgtagacccaaccacaggcactatcactaccacagccatcctggaccgtgagatctgggctgaaacacggttggtgctgatggccacagacagagggagcccagccctggtgggctcagctaccttgacggtgatggtcatcgacaccaatgacaatcgccccaccatcccccaaccctgggagctccgagtgtcagaagatgcgttattgggctcagagattgcacaggtaacagggaatgatgtggactcaggacccgtgctgtggtatgtgctaagcccatctgggccccaggatcccttcagtgttggccgctatggaggccgtgtctccctcacggggcccctggactttgagcagtgtgaccgctaccagctgcagctgctggcacatgatgggcctcatgagggcngtgccaacctcacagtgcttgtggaggatgtcaatgacaatgcacctgccttctcacagagcctctaccaggtaatgctgcttgagcacacacccccaggcagtgccattctctccgtctctgccactgatcgggactcaggtgccaacggtcacatttcctaccacctggcttcccctgccgatggcttcagtgttgaccccaacaatgggaccctgttcacaatagtgggaacagtggccttgggccatgacgggtcaggagcagtggatgtggtgctggaagcacgagaccacggggctccaggccgggcagcacgagccacagtgcacgtgcagctgcaggaccagaacgaccacgccccgagcttcacattgtcacactaccgtgtggctgtgactgaagacctgccccctggctccactctgctcaccctggaggctacagatgctgatggaagccgcagccatgccgctgtggactacagcatcatcagtggcaactggggccgagtcttccagctggaacccaggctggctgaggctggggagagtgctggaccaggcccccgggcactgggctgcctggtgttgcttgaacctctagactttgaaagcctgacacagtacaatctaacagtggctgcagctgaccgtgggcagccaccccaaagctcagtcgtgccagtcactgtcactgtactagatgtcaatgacaacccacctgtctttacccgagcatcctaccgtgtgacagtacctgangacacacctgttggagctgagctgctgcatgtagaggcctctgacgctgaccctggccctcatggcctcgtgcgtttcactgtcagctcaggcgacccatcagggctctttgagctggatgagagctcaggcaccttgcgactggcccatgccctggactgtgagacccaggctcgacatcagcttgtagtacaggctgctgaccctgctggtgcacactttgctttggcaccagtgacaattgaggtccaggatgtgaatgatcatggcccagccttcccactgaacttactcagcaccagcgtggccgagaatcagcctccaggcactctcgtgaccactctgcatgcaatcgacggggatgctggggcttttgggaggctccgttacagcctgttggaggctgggccaggacctgagggccgtgaggcatttgcactgaacagctcaacaggggagttgcgtgcgcgagtgccctttgactatgagcacacagaaagcttccggctgctggtgggtgctgctgatgctgggaatctctcagcctctgtcactgtgtcggtgctagtgactggagaggatgagtatgaccctgtatttctggcaccagctttccacttccaagtgcccgaaggtgcccggcgtggccacagcttgggtcacgtgcaggccacagatgaggatgggggtgccgatggcctggttctgtattcccttgccacctcttccccctattttggtattaaccagactacaggagccctgtacctgcgggtggacagtcgggcaccaggcagcggaacagccacctctgggggtgggggccggacccggcgggaagcaccacgggagctgaggctggaggtgatagcacgggggcctctgcctggttcccggagtgccacagtgcctgtgaccgtggatatcacccacaccgcactgggcctggcacctgacctcaacctgctattagtaggggccgtggcagcctccttgggagttgtggtggtgcttgcactggcagccctggtcctaggacttgttcgggcccgtagccgcaaggctgaggcagcccctggcccaatgtcacaggcagcacccctagccagtgactcactgcagaaactgggccgggagccacctagtccaccaccctctgagcacctctatcaccagactcttcccagctatggtgggccaggagctggaggaccctacccccgtggtggctccttggacccttcacattcaagtggccgaggatcagcagaggctgcagaggatgatgagatccgcatgatcaatgagttcccccgtgtggccagtgtggcctcctctctggctgcccgtggccctgactcaggcatccagcaggatgcagatggtctgagtgacacatcctgcgaaccacctgcccctgacacctggtataagggccgaaaggcagggctgctgctgccaggtgcaggagccactctctacagagaggaggggcccccagccactgccacagccttcctggggggctgtggcctgagccctgcacccactggggactatggcttcccagcagatggcaagccatgtgtggcaggtgcgctgacagccattgtggccggcgaggaggagctccgtggcagctataactgggactacctgctgagctggtgccctcagttccaaccactggccagtgtcttcacagagatcgctcggctcaaggatgaagctcggccatgtcccccagctccccgtatcgacccaccacccctcatcactgccgtggcccacccaggagccaagtctgtgccccccaagccagcaaacacagctgcagcccgggccatcttcccaccagcttctcaccgctcccccatcagccatgaaggctccctgtcctcagctgccatgtcccccagcttctcaccctctctgtctcctctggctgctcgctcacccgttgtctcaccatttggggtggcccagggtccctcagcctcagcactcagcgcagagtctggcctggagccacctgatgacacggagctgcacatctagctgtggcccaggctgggccccgacctgggatgcgcacagtgtccccaacgcaggccccactctgagcctgccctgggcagcctcggactatgactggctacggggaggccaccaccaggccccagctctccaccctgaactccccagccccctcagagtactaggaccacagaagccctgttgctcactgacctgtgaccaggtccaatgtggggagaaatatgaaggaggtagcagccctgggttctcctcagtgagggatccctgccctgcaccagcaccctgagatggagctgagactttatttattgggtccaaacatgttggagggaccgtcgacgcggccgcgaat

SEQ ID NO: 72263 - DNA, 8648 bp, Homo sapiens
  misc_feature (7364)..(7364): n is a, c, g, or t
  misc_feature (8128)..(8128): n is a, c, g, or t
gcggggggaggggaggggaggggagggggcgcggggccgcggcagcggagctcgcatcctcggcggggcggctgtgcaggaggcggcgcccgggcgtcagcggacggaccgatcgacggccaagggcgcgcggaccgacggcggctgcccggaggggatcgcgggcctcggagacagcgactgcggacgatgcgcggccccaggccccgcgcgagcgggcgctgcccggggggctgaccgcggccggacggcgccccagcaccgggcgagggagcccgcgtcgcgcggaggtcagggagcctgagctggagccagggccccagtgggacctgacccaaagtctgaggtcaagctgggcccagagcctggcctggagctggagcccaaggcacagctggactacccttgtcatgcagaaggagctgggcattgtgccttcctgccctggcatgaagagccccaggccccacctcctgctaccattgctgctgctgctgctgctgctgctgggggctggggtgccaggtgcctggggtcaggctgggagcctggacttgcagattgatgaggagcagccagcgggtacactgattggcgacatcagtgcggggcttccggcaggcacggcagctcctctcatgtacttcatctctgcccaagagggcagcggcgtgggcacagacctggccattgacgaacacagtggggtcgtccgtacagcccgtgtcttggaccgtgagcagcgggaccgctaccgcttcactgcagtcactcctgatggtgccaccgtagaagttacagtgcgagtggctgacatcaacgaccatgctccagccttcccacaggctcgggctgccctgcaggtacctgagcatacagcttttggcacccgctacccactggagcctgctcgtgatgcagatgctgggcgtctgggaacccagggctatgcgctatctggtgatggggctggagagaccttccggctggagacacgccccggtccagatgggactccagtacctgagctggtagttactggggaactggaccgagagaaccgctcacactatatgctacagctggaggcctatgatggtggttcacccccccggagggcccaggccctgctggacgtgacactgctggacatcaatgaccatgccccggctttcaatcagagccgctaccatgctgtggtgtctgagagcctggcccctggcagtcctgtcttgcaggtgttcgcatctgatgccgatgctggtgtcaatggggctgtgacttacgagatcaaccggaggcagagcgagggtgatggacccttctccatcgacgcacacacggggctgctgcagttagagcggccactggactttgagcagcggcgggtccatgaactggtggtgcaagcacgagatggtggggctcaccctgagctgggctcggcctttgtgactgtgcatgtgcgagatgccaatgacaatcagccctccatgactgtcatctttctcagtgcagatggctccccccaagtgtctgaggccgccccacctggacagctcgttgctcgcatctctgtgtcagacccagatgatggtgactttgcccatgtcaatgtgtccctggaaggtggagagggccactttgccctaagcacccaagacagcgtcatctatctggtgtgtgtggctcggcggctggatcgagaggagagggatgcctataacttgagggttacagccacagactcaggctcacctccactgcgggctgaggctgcctttgtgctgcacgtcactgatgtcaacgacaatgcacctgcctttgaccgccagctctaccgacctgagcccctgcctgaggttgcgctgcctggcagctttgtagtgcgggtgactgctcgggatcctgaccaaggcaccaatggtcaggtcacttatagcctagcccctggcgcccacacccactggttctccattgaccccacctcaggcattatcactacggctgcctcactggactatgagttggaacctcagccacagctgattgtggtggccacagatggtggcctgccccctctagcctcctctgccacagttagcgtggccctgcaagatgtgaatgataatgagccccaattccagaggactttctacaatgcctcactgcctgagggcacccagcctggaacttgcttcctgcaggtgacagccacagacgcggatagtggcccatttggcctcctctcctattccttgggtgctggacttgggtcctccggatctcccccattccgcattgatgcccatagcggtgatgtgtgcacaacccggaccctggaccgtgaccaggggccctcaagctttgacttcacagtgacagctgtggatgggggaggcctcaagtccatggtatatgtgaaggtgtttctgtcagacgagaatgacaaccctcctcagttttatccacgggagtatgctgccagtataagtgcccagagtccaccaggcacagctgtgctgaggttgcgtgcccatgaccctgaccagggatcccatgggcgactctcctaccatatcctggctggcaacagccccccactttttaccttggatgagcaatcagggctgttgacagtagcctggcccttggccagacgggccaattctgtggtgcagctggagatcggggctgaggacggaggtggcctacaggcagaacccagtgcccgagtggacatcagcattgtgcctggaacccccacaccacccatatttgagcaactacagtatgttttttctgtgccagaggatgtggcaccaggcaccagtgtgggcatagtccaggcacacaacccaccaggtcgcttggcacctgtgaccctttccctatcaggtggggatccccgaggactcttctccctagatgcggtatcaggactgttgcaaacacttcgccctctggaccgggagctactgggaccagtgttggagctggaggtgcgagcaggcagtggagtgcccccagctttcgctgtagctcgggtgcgtgtgctgctggatgatgtgaatgacaactcccctgcctttcctgcacctgaagacacggtattgctaccaccaaacactgccccagggactcccatctatacactgcgggctcttgaccccgactcaggtgttaacagtcgagtcacctttaccctgcttgctgggggtggtggagccttcaccgtggaccccaccacaggccatgtacggcttatgaggccttggctccccgattcaacagccctacctaccgtgtggacctgccctcaggcaccactgctggaactcaggtcctgcaagtgcaggcccaagcaccagatgggggccctatcacctatcaccttgcagcagagggagcaagtagcccctttggcctggagccacagagtgggtggctatgggtgcgggcagcactagaccgtgaggcccaggaattgtacatactgaaggtaatggcagtgtctgggtccaaagctgagttggggcagcagacaggcacagccaccgtgagggtcagcatcctcaaccagaatgaacacagtccccgcttgtctgaggatcccaccttcctggctgtggctgagaaccagcccccagggaccagcgtgggccgagtctttgccactgaccgagactcaggacccaatggacgtctgacctacagcctgcaacagctgtctgaagacagcaaggccttccgcatccacccccagactggagaagtgaccacactccaaaccctggaccgtgagcagcagagcagctatcagctcctggtgcaggtgcaggatggagggagcccaccccgcagcaccacaggcactgtgcatgttgcagtgcttgacctcaacgacaacagccccacgttcctgcaggcttcaggagctgctggtgggggcctccctatacaggtaccagaccgcgtgcctccaggaacactggtgacgactctgcaggcgaaggatccagatgagggggagaatgggaccatcttgtacacgctaactggtcctggctcagagcttttctctctgcaccctcactcaggggagctgctcactgcagctcccctgatccgagcagagcggccccactatgtgctgacactgagtgctcatgaccaaggcagccctcctcgaagtgccagcctccagctgctggtgcaggtgcttccctcagctcgcttggccgagccgcccccagatctcgcagagcgggacccagcggcaccagtgcctgtcgtgctgacggtgacagcagctgagggactgcggcccggctctctgttgggctcggtggcagcgccagagcccgcgggtgtgggtgcactcacctacacactggtgggcggtgccgatcccgagggcaccttcgcgctggatgcggcctcagggcgcttgtacctggcgcggcccctggacttcgaagctggcccgccgtggcgcgcgctcacggtacgcgctgaggggccgggaggcgcgggcgcgcggctgctgcgagtgcaggtgcaagtgcaggacgagaatgagcatgcgcccgcctttgcgcgcgacccgctggcgctggcgctgccagagaacccggagcccggcgcagcgctgtacactttccgcgcgtcggacgccgacggccccggccccaatagcgacgtgcgctaccgcctgctgcgccaggagccgcccgtgccggcgcttcgcctggacgcgcgcaccggggcgctcagcgctccgcgcggcctggaccgagagaccactcccgcgctgctgctgctggtggaagccaccgaccggcccgccaacgccagccgccgtcgtgcagcgcgcgtttcagcgcgcgtcttcgtcacggatgagaatgacaacgcgcctgtcttcgcctcgccgtcacgcgtgcgcctcccagaggaccagccgcctgggcccgcggccctgcacgtggtagcccgggacccggatctgggcgaggctgcacgcgtgtcctatcggctggcatctggcggggacggccacttccggctgcactcaagcactggagcgctgtccgtggtgcggccgttggaccgcgaacaacgagctgagcacgtactgacagtggtggcctcagaccacggctccccgccgcgctcggccacgcaggtcctgaccgtcagtgtcgctgacgtcaacgacgaggcgcctactttccagcagcaggagtacagcgtcctcttgcgtgagaacaaccctcctggcacatctctgctcaccctgcgagcaaccgaccccgacgtgggggccaacgggcaagtgacttatggaggcgtctctagcgaaagcttttctctggatcctgacactggtgttctcacgactcttcgggccctggatcgagaggaacaggaggagatcaacctgacagtgtatgcccaggacaggggctcacctcctcagttaacgcatgtcactgttcgagtggctgtggaggatgagaatgaccatgcaccaacctttgggagtgcccatctctctctggaggtgcctgagggccaggacccccagacccttaccatgcttcgggcctctgatccagatgtgggagccaatgggcagttgcagtaccgcatcctagatggggacccatcaggagcctttgtcctagaccttgcttctggagagtttggcaccatgcggccactagacagagaagtggagccagctttccagctgaggatagaggcccgggatggaggccagccagctctcagtgccacgctgcttttgacagtgacagtgctggatgccaatgaccatgctccagcctttcctgtgcctgcctactcggtggaggtgccggaggatgtgcctgcagggaccctgctgctgcagctacaggctcatgaccctgatgctggagctaatggccatgtgacctactacctgggcgccggtacagcaggagccttcctgctggagcccagctctggagaactgcgcacagctgcagccttggacagagaacagtgtcccagctacaccttttctgtgagtgcagtggatggtgcagctgctgggcccctaagcaccacagtgtctgtcaccatcacggtgcgcgatgtcaatgaccatgcacccaccttccccaccagtcctctgcgcctacgtctgccccgcccaggccccagcttcagtaccccaaccctggctctggccacactgagagctgaagatcgtgatgctggtgccaatgcttccattctgtaccggctggcaggcacaccacctcctggcactactgtggactcttacactggtgaaatccgcgtggcccgctctcctgtagctctaggcccccgagatcgtgtcctcttcattgtggccactgatcttggccgtccagctcgctctgccactggtgtgatcattgttggactgcagggggaagctgagcgtggaccccgctttccccgggctagcagtgaggctacgattcgtgagaatgcgcccccagggactcctattgtctcccccagggccgtccatgcaggaggcacaaatggacccatcacctacagcattctcagtgggaatgagaaagggacattctccatccagcctagtacaggtgccatcacagttcgctcagcagaggggctagacttcgaggtgagtccacggctgcgactggtgctgcaggcagagagtggaggagcctttgccttcactgtgctgaccctgaccctgcaagatgccaacgacaatgctccccgtttcctgcggccccattatgtggccttccttcctgagtcccggcccttggaggggcccctgctgcaggtggaggcggatgacctggatcaaggctctggaggacagatttcctacagtctggctgcatcccagccggcacgtggattgttccacgtagacccaaccacaggcactatcactaccacagccatcctggaccgtgagatctgggctgaaacacggttggtgctgatggccacagacagagggagcccagccctggtgggctcagctaccttgacggtgatggtcatcgacaccaatgacaatcgccccaccatcccccaaccctgggagctccgagtgtcagaagatgcgttattgggctcagagattgcacaggtaacagggaatgatgtggactcaggacccgtgctgtggtatgtgctaagcccatctgggccccaggatcccttcagtgttggccgctatggaggccgtgtctccctcacggggcccctggactttgagcagtgtgaccgctaccagctgcagctgctggcacatgatgggcctcatgagggcngtgccaacctcacagtgcttgtggaggatgtcaatgacaatgcacctgccttctcacagagcctctaccaggtaatgctgcttgagcacacacccccaggcagtgccattctctccgtctctgccactgatcgggactcaggtgccaacggtcacatttcctaccacctggcttcccctgccgatggcttcagtgttgaccccaacaatgggaccctgttcacaatagtgggaacagtggccttgggccatgacgggtcaggagcagtggatgtggtgctggaagcacgagaccacggggctccaggccgggcagcacgagccacagtgcacgtgcagctgcaggaccagaacgaccacgccccgagcttcacattgtcacactaccgtgtggctgtgactgaagacctgccccctggctccactctgctcaccctggaggctacagatgctgatggaagccgcagccatgccgctgtggactacagcatcatcagtggcaactggggccgagtcttccagctggaacccaggctggctgaggctggggagagtgctggaccaggcccccgggcactgggctgcctggtgttgcttgaacctctagactttgaaagcctgacacagtacaatctaacagtggctgcagctgaccgtgggcagccaccccaaagctcagtcgtgccagtcactgtcactgtactagatgtcaatgacaacccacctgtctttacccgagcatcctaccgtgtgacagtacctgangacacacctgttggagctgagctgctgcatgtagaggcctctgacgctgaccctggccctcatggcctcgtgcgtttcactgtcagctcaggcgacccatcagggctctttgagctggatgagagctcaggcaccttgcgactggcccatgccctggactgtgagacccaggctcgacatcagcttgtagtacaggctgctgaccctgctggtgcacactttgctttggcaccagtgacaattgaggtccaggatgtgaatgatcatggcccagccttcccactgaacttactcagcaccagcgtggccgagaatcagcctccaggcactctcgtgaccactctgcatgcaatcgacggggatgctggggcttttgggaggctccgttacagcctgttggaggctgggccaggacctgagggccgtgaggcatttgcactgaacagctcaacaggggagttgcgtgcgcgagtgccctttgactatgagcacacattatggagggatcctcaatcaccca

SEQ ID NO: 72264 - DNA, 893 bp, Homo sapiens
  misc_feature (847)..(847): n is a, c, g, or t
  misc_feature (850)..(850): n is a, c, g, or t
  misc_feature (853)..(853): n is a, c, g, or t
  misc_feature (860)..(860): n is a, c, g, or t
  misc_feature (863)..(863): n is a, c, g, or t
gctccatccagcctagtacaggtgccatcacagttcgctcagcagaggggctagacttcgaggtgagtccacggctgcgactggtgctgcaggcagagagtggaggagcctttgccttcactgtgctgaccctgaccctgcaagatgctggggcttttgggaggctccgttacagcctgttggaggctgggccaggacctgagggccgtgaggcatttgcactgaacagctcaacaggggagttgcgtgcgcgagtgccctttgactatgagcacacagaaagcttccggctgctggtgggtgctgctgatgctgggaatctctcagcctctgtcactgtgtcggtgctagtgactggagaggatgagtatgaccctgtatttctggcaccagctttccacttccaagtgcccgaaggtgcccggcgtggccacagcttgggtcacgtgcaggccacagatgaggatgggggtgccgatggcctggttctgtattcccttgccacctcttccccctattttggtattaaccagactacaggagccctgtacctgcgggtggacagtcgggcaccaggcagcggaacagccacctctgggggtgggggccggacccggcgggaagcaccacgggagctgaggctggaggtgatagcacgggggcctctgcctggttcccggagtgccacagtgcctgtgaccgtggatatcacccacaccgcactgggcctggcacctgacctcaacctgctattagtaggggccgtggcagcctccttgggagttgtggtggtgcttgcactggcagccctggtcctaggacttgttcgggcccgtagcgaggttgnggnccnggccatngtnaggggccttgctgtggttcttgggaatttg

SEQ ID NO: 72265 - DNA, 2432 bp, Homo sapiens
gctccatccagcctagtacaggtgccatcacagttcgctcagcagaggggctagacttcgaggtgagtccacggctgcgactggtgctgcaggcagagagtggaggagcctttgccttcactgtgctgaccctgaccctgcaagatgctggggcttttgggaggctccgttacagcctgttggaggctgggccaggacctgagggccgtgaggcatttgcactgaacagctcaacaggggagttgcgtgcgcgagtgccctttgactatgagcacacagaaagcttccggctgctggtgggtgctgctgatgctgggaatctctcagcctctgtcactgtgtcggtgctagtgactggagaggatgagtatgaccctgtatttctggcaccagctttccacttccaagtgcccgaaggtgcccggcgtggccacagcttgggtcacgtgcaggccacagatgaggatgggggtgccgatggcctggttctgtattcccttgccacctcttccccctattttggtattaaccagactacaggagccctgtacctgcgggtggacagtcgggcaccaggcagcggaacagccacctctgggggtgggggccggacccggcgggaagcaccacgggagctgaggctggaggtgatagcacgggggcctctgcctggttcccggagtgccacagtgcctgtgaccgtggatatcacccacaccgcactgggcctggcacctgacctcaacctgctattagtaggggccgtggcagcctccttgggagttgtggtggtgcttgcactggcagccctggtcctaggacttgttcgggcccgtagccgcaaggctgaggcagcccctggcccaatgtcacaggcagcacccctagccagtgactcactgcagaaactgggccgggagccacctagtccaccaccctctgagcacctctatcaccagactcttcccagctatggtgggccaggagctggaggaccctacccccgtggtggctccttggacccttcacattcaagtggccgaggatcagcagaggctgcagaggatgatgagatccgcatgatcaatgagttcccccgtgtggccagtgtggcctcctctctggctgcccgtggccctgactcaggcatccagcaggatgcagatggtctgagtgacacatcctgcgaaccacctgcccctgacacctggtataagggccgaaaggcagggctgctgctgccaggtgcaggagccactctctacagagaggaggggcccccagccactgccacagccttcctggggggctgtggcctgagccctgcacccactggggactatggcttcccagcagatggcaagccatgtgtggcaggtgcgctgacagccattgtggccggcgaggaggagctccgtggcagctataactgggactacctgctgagctggtgccctcagttccaaccactggccagtgtcttcacagagatcgctcggctcaaggatgaagcgtggcccacccaggagccaagtctgtgccccccaagccagcaaacacagctgcagcccgggccatcttcccaccagcttctcaccgctcccccatcagccatgaaggctccctgtcctcagctgccatgtcccccagcttctcaccctctctgtctcctctggctgctcgctcacccgttgtctcaccatttggggtggcccagggtccctcagcctcagcactcagcgcagagtctggcctggagccacctgatgacacggagctgcacatctagctgtggcccaggctgggccccgacctgggatgcgcacagtgtccccaacgcaggccccactctgagcctgccctgggcagcctcggactatgactggctacggggaggccaccaccaggccccagctctccaccctgaactccccagccccctcagagtactaggaccacagaagccctgttgctcactgacctgtgaccaggtccaatgtggggagaaatatgaaggaggtagcagccctgggttctcctcagtgagggatccctgccctgcaccagcaccctgagatggagctgagactttatttattgggggtagggggatggaggaggtccctccaacatgtttggacccagctcctttgggttccactgacacccctgcccctgcccctgcccagaaccaagtgccatttctcactctggagccttaataaactgcaatttgtatccagtctccagctttgttctatagggatgactggaagacacctggcagagtattgtggatacctcaggaggcacagaggggtggtggggtggggatggcactgggagctcaggagcctagcctgaggctgatgatcacatctctctgcagctattcttttccctctaatatgggcaaagaggccagcagggcc

SEQ ID NO: 72266 - DNA, 10564 bp, Homo sapiens
  misc_feature (7364)..(7364): n is a, c, g, or t
  misc_feature (8128)..(8128): n is a, c, g, or t
gcggggggaggggaggggaggggagggggcgcggggccgcggcagcggagctcgcatcctcggcggggcggctgtgcaggaggcggcgcccgggcgtcagcggacggaccgatcgacggccaagggcgcgcggaccgacggcggctgcccggaggggatcgcgggcctcggagacagcgactgcggacgatgcgcggccccaggccccgcgcgagcgggcgctgcccggggggctgaccgcggccggacggcgccccagcaccgggcgagggagcccgcgtcgcgcggaggtcagggagcctgagctggagccagggccccagtgggacctgacccaaagtctgaggtcaagctgggcccagagcctggcctggagctggagcccaaggcacagctggactacccttgtcatgcagaaggagctgggcattgtgccttcctgccctggcatgaagagccccaggccccacctcctgctaccattgctgctgctgctgctgctgctgctgggggctggggtgccaggtgcctggggtcaggctgggagcctggacttgcagattgatgaggagcagccagcgggtacactgattggcgacatcagtgcggggcttccggcaggcacggcagctcctctcatgtacttcatctctgcccaagagggcagcggcgtgggcacagacctggccattgacgaacacagtggggtcgtccgtacagcccgtgtcttggaccgtgagcagcgggaccgctaccgcttcactgcagtcactcctgatggtgccaccgtagaagttacagtgcgagtggctgacatcaacgaccatgctccagccttcccacaggctcgggctgccctgcaggtacctgagcatacagcttttggcacccgctacccactggagcctgctcgtgatgcagatgctgggcgtctgggaacccagggctatgcgctatctggtgatggggctggagagaccttccggctggagacacgccccggtccagatgggactccagtacctgagctggtagttactggggaactggaccgagagaaccgctcacactatatgctacagctggaggcctatgatggtggttcacccccccggagggcccaggccctgctggacgtgacactgctggacatcaatgaccatgccccggctttcaatcagagccgctaccatgctgtggtgtctgagagcctggcccctggcagtcctgtcttgcaggtgttcgcatctgatgccgatgctggtgtcaatggggctgtgacttacgagatcaaccggaggcagagcgagggtgatggacccttctccatcgacgcacacacggggctgctgcagttagagcggccactggactttgagcagcggcgggtccatgaactggtggtgcaagcacgagatggtggggctcaccctgagctgggctcggcctttgtgactgtgcatgtgcgagatgccaatgacaatcagccctccatgactgtcatctttctcagtgcagatggctccccccaagtgtctgaggccgccccacctggacagctcgttgctcgcatctctgtgtcagacccagatgatggtgactttgcccatgtcaatgtgtccctggaaggtggagagggccactttgccctaagcacccaagacagcgtcatctatctggtgtgtgtggctcggcggctggatcgagaggagagggatgcctataacttgagggttacagccacagactcaggctcacctccactgcgggctgaggctgcctttgtgctgcacgtcactgatgtcaacgacaatgcacctgcctttgaccgccagctctaccgacctgagcccctgcctgaggttgcgctgcctggcagctttgtagtgcgggtgactgctcgggatcctgaccaaggcaccaatggtcaggtcacttatagcctagcccctggcgcccacacccactggttctccattgaccccacctcaggcattatcactacggctgcctcactggactatgagttggaacctcagccacagctgattgtggtggccacagatggtggcctgccccctctagcctcctctgccacagttagcgtggccctgcaagatgtgaatgataatgagccccaattccagaggactttctacaatgcctcactgcctgagggcacccagcctggaacttgcttcctgcaggtgacagccacagacgcggatagtggcccatttggcctcctctcctattccttgggtgctggacttgggtcctccggatctcccccattccgcattgatgcccatagcggtgatgtgtgcacaacccggaccctggaccgtgaccaggggccctcaagctttgacttcacagtgacagctgtggatgggggaggcctcaagtccatggtatatgtgaaggtgtttctgtcagacgagaatgacaaccctcctcagttttatccacgggagtatgctgccagtataagtgcccagagtccaccaggcacagctgtgctgaggttgcgtgcccatgaccctgaccagggatcccatgggcgactctcctaccatatcctggctggcaacagccccccactttttaccttggatgagcaatcagggctgttgacagtagcctggcccttggccagacgggccaattctgtggtgcagctggagatcggggctgaggacggaggtggcctacaggcagaacccagtgcccgagtggacatcagcattgtgcctggaacccccacaccacccatatttgagcaactacagtatgttttttctgtgccagaggatgtggcaccaggcaccagtgtgggcatagtccaggcacacaacccaccaggtcgcttggcacctgtgaccctttccctatcaggtggggatccccgaggactcttctccctagatgcggtatcaggactgttgcaaacacttcgccctctggaccgggagctactgggaccagtgttggagctggaggtgcgagcaggcagtggagtgcccccagctttcgctgtagctcgggtgcgtgtgctgctggatgatgtgaatgacaactcccctgcctttcctgcacctgaagacacggtattgctaccaccaaacactgccccagggactcccatctatacactgcgggctcttgaccccgactcaggtgttaacagtcgagtcacctttaccctgcttgctgggggtggtggagccttcaccgtggaccccaccacaggccatgtacggcttatgaggccttggctccccgattcaacagccctacctaccgtgtggacctgccctcaggcaccactgctggaactcaggtcctgcaagtgcaggcccaagcaccagatgggggccctatcacctatcaccttgcagcagagggagcaagtagcccctttggcctggagccacagagtgggtggctatgggtgcgggcagcactagaccgtgaggcccaggaattgtacatactgaaggtaatggcagtgtctgggtccaaagctgagttggggcagcagacaggcacagccaccgtgagggtcagcatcctcaaccagaatgaacacagtccccgcttgtctgaggatcccaccttcctggctgtggctgagaaccagcccccagggaccagcgtgggccgagtctttgccactgaccgagactcaggacccaatggacgtctgacctacagcctgcaacagctgtctgaagacagcaaggccttccgcatccacccccagactggagaagtgaccacactccaaaccctggaccgtgagcagcagagcagctatcagctcctggtgcaggtgcaggatggagggagcccaccccgcagcaccacaggcactgtgcatgttgcagtgcttgacctcaacgacaacagccccacgttcctgcaggcttcaggagctgctggtgggggcctccctatacaggtaccagaccgcgtgcctccaggaacactggtgacgactctgcaggcgaaggatccagatgagggggagaatgggaccatcttgtacacgctaactggtcctggctcagagcttttctctctgcaccctcactcaggggagctgctcactgcagctcccctgatccgagcagagcggccccactatgtgctgacactgagtgctcatgaccaaggcagccctcctcgaagtgccagcctccagctgctggtgcaggtgcttccctcagctcgcttggccgagccgcccccagatctcgcagagcgggacccagcggcaccagtgcctgtcgtgctgacggtgacagcagctgagggactgcggcccggctctctgttgggctcggtggcagcgccagagcccgcgggtgtgggtgcactcacctacacactggtgggcggtgccgatcccgagggcaccttcgcgctggatgcggcctcagggcgcttgtacctggcgcggcccctggacttcgaagctggcccgccgtggcgcgcgctcacggtacgcgctgaggggccgggaggcgcgggcgcgcggctgctgcgagtgcaggtgcaagtgcaggacgagaatgagcatgcgcccgcctttgcgcgcgacccgctggcgctggcgctgccagagaacccggagcccggcgcagcgctgtacactttccgcgcgtcggacgccgacggccccggccccaatagcgacgtgcgctaccgcctgctgcgccaggagccgcccgtgccggcgcttcgcctggacgcgcgcaccggggcgctcagcgctccgcgcggcctggaccgagagaccactcccgcgctgctgctgctggtggaagccaccgaccggcccgccaacgccagccgccgtcgtgcagcgcgcgtttcagcgcgcgtcttcgtcacggatgagaatgacaacgcgcctgtcttcgcctcgccgtcacgcgtgcgcctcccagaggaccagccgcctgggcccgcggccctgcacgtggtagcccgggacccggatctgggcgaggctgcacgcgtgtcctatcggctggcatctggcggggacggccacttccggctgcactcaagcactggagcgctgtccgtggtgcggccgttggaccgcgaacaacgagctgagcacgtactgacagtggtggcctcagaccacggctccccgccgcgctcggccacgcaggtcctgaccgtcagtgtcgctgacgtcaacgacgaggcgcctactttccagcagcaggagtacagcgtcctcttgcgtgagaacaaccctcctggcacatctctgctcaccctgcgagcaaccgaccccgacgtgggggccaacgggcaagtgacttatggaggcgtctctagcgaaagcttttctctggatcctgacactggtgttctcacgactcttcgggccctggatcgagaggaacaggaggagatcaacctgacagtgtatgcccaggacaggggctcacctcctcagttaacgcatgtcactgttcgagtggctgtggaggatgagaatgaccatgcaccaacctttgggagtgcccatctctctctggaggtgcctgagggccaggacccccagacccttaccatgcttcgggcctctgatccagatgtgggagccaatgggcagttgcagtaccgcatcctagatggggacccatcaggagcctttgtcctagaccttgcttctggagagtttggcaccatgcggccactagacagagaagtggagccagctttccagctgaggatagaggcccgggatggaggccagccagctctcagtgccacgctgcttttgacagtgacagtgctggatgccaatgaccatgctccagcctttcctgtgcctgcctactcggtggaggtgccggaggatgtgcctgcagggaccctgctgctgcagctacaggctcatgaccctgatgctggagctaatggccatgtgacctactacctgggcgccggtacagcaggagccttcctgctggagcccagctctggagaactgcgcacagctgcagccttggacagagaacagtgtcccagctacaccttttctgtgagtgcagtggatggtgcagctgctgggcccctaagcaccacagtgtctgtcaccatcacggtgcgcgatgtcaatgaccatgcacccaccttccccaccagtcctctgcgcctacgtctgccccgcccaggccccagcttcagtaccccaaccctggctctggccacactgagagctgaagatcgtgatgctggtgccaatgcttccattctgtaccggctggcaggcacaccacctcctggcactactgtggactcttacactggtgaaatccgcgtggcccgctctcctgtagctctaggcccccgagatcgtgtcctcttcattgtggccactgatcttggccgtccagctcgctctgccactggtgtgatcattgttggactgcagggggaagctgagcgtggaccccgctttccccgggctagcagtgaggctacgattcgtgagaatgcgcccccagggactcctattgtctcccccagggccgtccatgcaggaggcacaaatggacccatcacctacagcattctcagtgggaatgagaaagggacattctccatccagcctagtacaggtgccatcacagttcgctcagcagaggggctagacttcgaggtgagtccacggctgcgactggtgctgcaggcagagagtggaggagcctttgccttcactgtgctgaccctgaccctgcaagatgccaacgacaatgctccccgtttcctgcggccccattatgtggccttccttcctgagtcccggcccttggaggggcccctgctgcaggtggaggcggatgacctggatcaaggctctggaggacagatttcctacagtctggctgcatcccagccggcacgtggattgttccacgtagacccaaccacaggcactatcactaccacagccatcctggaccgtgagatctgggctgaaacacggttggtgctgatggccacagacagagggagcccagccctggtgggctcagctaccttgacggtgatggtcatcgacaccaatgacaatcgccccaccatcccccaaccctgggagctccgagtgtcagaagatgcgttattgggctcagagattgcacaggtaacagggaatgatgtggactcaggacccgtgctgtggtatgtgctaagcccatctgggccccaggatcccttcagtgttggccgctatggaggccgtgtctccctcacggggcccctggactttgagcagtgtgaccgctaccagctgcagctgctggcacatgatgggcctcatgagggcngtgccaacctcacagtgcttgtggaggatgtcaatgacaatgcacctgccttctcacagagcctctaccaggtaatgctgcttgagcacacacccccaggcagtgccattctctccgtctctgccactgatcgggactcaggtgccaacggtcacatttcctaccacctggcttcccctgccgatggcttcagtgttgaccccaacaatgggaccctgttcacaatagtgggaacagtggccttgggccatgacgggtcaggagcagtggatgtggtgctggaagcacgagaccacggggctccaggccgggcagcacgagccacagtgcacgtgcagctgcaggaccagaacgaccacgccccgagcttcacattgtcacactaccgtgtggctgtgactgaagacctgccccctggctccactctgctcaccctggaggctacagatgctgatggaagccgcagccatgccgctgtggactacagcatcatcagtggcaactggggccgagtcttccagctggaacccaggctggctgaggctggggagagtgctggaccaggcccccgggcactgggctgcctggtgttgcttgaacctctagactttgaaagcctgacacagtacaatctaacagtggctgcagctgaccgtgggcagccaccccaaagctcagtcgtgccagtcactgtcactgtactagatgtcaatgacaacccacctgtctttacccgagcatcctaccgtgtgacagtacctgangacacacctgttggagctgagctgctgcatgtagaggcctctgacgctgaccctggccctcatggcctcgtgcgtttcactgtcagctcaggcgacccatcagggctctttgagctggatgagagctcaggcaccttgcgactggcccatgccctggactgtgagacccaggctcgacatcagcttgtagtacaggctgctgaccctgctggtgcacactttgctttggcaccagtgacaattgaggtccaggatgtgaatgatcatggcccagccttcccactgaacttactcagcaccagcgtggccgagaatcagcctccaggcactctcgtgaccactctgcatgcaatcgacggggatgctggggcttttgggaggctccgttacagcctgttggaggctgggccaggacctgagggccgtgaggcatttgcactgaacagctcaacaggggagttgcgtgcgcgagtgccctttgactatgagcacacagaaagcttccggctgctggtgggtgctgctgatgctgggaatctctcagcctctgtcactgtgtcggtgctagtgactggagaggatgagtatgaccctgtatttctggcaccagctttccacttccaagtgcccgaaggtgcccggcgtggccacagcttgggtcacgtgcaggccacagatgaggatgggggtgccgatggcctggttctgtattcccttgccacctcttccccctattttggtattaaccagactacaggagccctgtacctgcgggtggacagtcgggcaccaggcagcggaacagccacctctgggggtgggggccggacccggcgggaagcaccacgggagctgaggctggaggtgatagcacgggggcctctgcctggttcccggagtgccacagtgcctgtgaccgtggatatcacccacaccgcactgggcctggcacctgacctcaacctgctattagtaggggccgtggcagcctccttgggagttgtggtggtgcttgcactggcagccctggtcctaggacttgttcgggcccgtagccgcaaggctgaggcagcccctggcccaatgtcacaggcagcacccctagccagtgactcactgcagaaactgggccgggagccacctagtccaccaccctctgagcacctctatcaccagactcttcccagctatggtgggccaggagctggaggaccctacccccgtggtggctccttggacccttcacattcaagtggccgaggatcagcagaggctgcagaggatgatgagatccgcatgatcaatgagttcccccgtgtggccagtgtggcctcctctctggctgcccgtggccctgactcaggcatccagcaggatgcagatggtctgagtgacacatcctgcgaaccacctgcccctgacacctggtataagggccgaaaggcagggctgctgctgccaggtgcaggagccactctctacagagaggaggggcccccagccactgccacagccttcctggggggctgtggcctgagccctgcacccactggggactatggcttcccagcagatggcaagccatgtgtggcaggtgcgctgacagccattgtggccggcgaggaggagctccgtggcagctataactgggactacctgctgagctggtgccctcagttccaaccactggccagtgtcttcacagagatcgctcggctcaaggatgaagctcggccatgtcccccagctccccgtatcgacccaccacccctcatcactgccgtggcccacccaggagccaagtctgtgccccccaagccagcaaacacagctgcagcccgggccatcttcccaccagcttctcaccgctcccccatcagccatgaaggctccctgtcctcagctgccatgtcccccactctccaccctgaactccccagccccctcagagtactaggaccacagaagccctgttgctcactgacctgtgaccaggtccaatgtggggagaaatatgaaggaggtagcagccctgggttctcctcagtgagggatccctgccctgcaccagcaccctgagatggagctgagactttatttattgggggtagggggatggaggaggtccctccaacatgtttggacccagctcctttgggttccactgacacccctgcccctgcccctgcccagaaccaagtgccatttctcactctggagccttaataaactgcaatttgtatccagtctccagctttgttctatagggatgactggaagacacctggcagagtattgtggatacctcaggaggcacagaggggtggtggggtggggatggcactgggagctcaggagcctagcctgaggctgatgatcacatctctctgcagctattcttttccctctaatatgggcaaagaggccagcagggcc

SEQ ID NO: 72267 - DNA, 3816 bp, Homo sapiens
gcggggggaggggaggggaggggagggggcgcggggccgcggcagcggagctcgcatcctcggcggggcggctgtgcaggaggcggcgcccgggcgtcagcggacggaccgatcgacggccaagggcgcgcggaccgacggcggctgcccggaggggatcgcgggcctcggagacagcgactgcggacgatgcgcggccccaggccccgcgcgagcgggcgctgcccggggggctgaccgcggccggacggcgccccagcaccgggcgagggagcccgcgtcgcgcggaggtcagggagcctgagctggagccagggccccagtgggacctgacccaaagtctgaggtcaagctgggcccagagcctggcctggagctggagcccaaggcacagctggactacccttgtcatgcagaaggagctgggcattgtgccttcctgccctggcatgaagagccccaggccccacctcctgctaccattgctgctgctgctgctgctgctgctgggggctggggtgccaggtgcctggggtcaggctgggagcctggacttgcagattgatgaggagcagccagcgggtacactgattggcgacatcagtgcggggcttccggcaggcacggcagctcctctcatgtacttcatctctgcccaagagggcagcggcgtgggcacagacctggccattgacgaacacagtggggtcgtccgtacagcccgtgtcttggaccgtgagcagcgggaccgctaccgcttcactgcagtcactcctgatggtgccaccgtagaagttacagtgcgagtggctgacatcaacgaccatgctccagccttcccacaggctcgggctgccctgcaggtacctgagcatacagcttttggcacccgctacccactggagcctgctcgtgatgcagatgctgggcgtctgggaacccagggctatgcgctatctggtgatggggctggagagaccttccggctggagacacgccccggtccagatgggactccagtacctgagctggtagttactggggaactggaccgagagaaccgctcacactatatgctacagctggaggcctatgatggtggttcacccccccggagggcccaggccctgctggacgtgacactgctggacatcaatgaccatgccccggctttcaatcagagccgctaccatgctgtggtgtctgagagcctggcccctggcagtcctgtcttgcaggtgttcgcatctgatgccgatgctggtgtcaatggggctgtgacttacgagatcaaccggaggcagagcgagggtgatggacccttctccatcgacgcacacacggggctgctgcagttagagcggccactggactttgagcagcggcgggtccatgaactggtggtgcaagcacgagatggtggggctcaccctgagctgggctcggcctttgtgactgtgcatgtgcgagatgccaatgacaatcagccctccatgactgtcatctttctcagtgcagatggctccccccaagtgtctgaggccgccccacctggacagctcgttgctcgcatctctgtgtcagacccagatgatggtgactttgcccatgtcaatgtgtccctggaaggtggagagggccactttgccctaagcacccaagacagcgtcatctatctggtgtgtgtggctcggcggctggatcgagaggagagggatgcctataacttgagggttacagccacagactcaggctcacctccactgcgggctgaggctgcctttgtgctgcacgtcactgatgtcaacgacaatgcacctgcctttgaccgccagctctaccgacctgagcccctgcctgaggttgcgctgcctggcagctttgtagtgcgggtgactgctcgggatcctgaccaaggcaccaatggtcaggtcacttatagcctagcccctggcgcccacacccactggttctccattgaccccacctcaggcattatcactacggctgcctcactggactatgagttggaacctcagccacagctgattgtggtggccacagatggtggcctgccccctctagcctcctctgccacagttagcgtggccctgcaagatgtgaatgataatgagccccaattccagaggactttctacaatgcctcactgcctgagggcacccagcctggaacttgcttcctgcaggtgacagccacagacgcggatagtggcccatttggcctcctctcctattccttgggtgctggacttgggtcctccggatctcccccattccgcattgatgcccatagcggtgatgtgtgcacaacccggaccctggaccgtgaccaggggccctcaagctttgacttcacagtgacagctgtggatgggggaggcctcaagtccatggtatatgtgaaggtgtttctgtcagacgagaatgacaaccctcctcagttttatccacgggagtatgctgccagtataagtgcccagagtccaccaggcacagctgtgctgaggttgcgtgcccatgaccctgaccagggatcccatgggcgactctcctaccatatcctggctggcaacagccccccactttttaccttggatgagcaatcagggctgttgacagtagcctggcccttggccagacgggccaattctgtggtgcagctggagatcggggctgaggacggaggtggcctacaggcagaacccagtgcccgagtggacatcagcattgtgcctggaacccccacaccacccatatttgagcaactacagtatgttttttctgtgccagaggatgtggcaccaggcaccagtgtgggcatagtccaggcacacaacccaccaggtcgcttggcacctgtgaccctttccctatcaggtggggatccccgaggactcttctccctagatgcggtatcaggactgttgcaaacacttcgccctctggaccgggagctactgggaccagtgttggagctggaggtgcgagcaggcagtggagtgcccccagctttcgctgtagctcgggtgcgtgtgctgctggatgatgtgaatgacaactcccctgcctttcctgcacctgaagacacggtattgctaccaccaaacactgccccagggactcccatctatacactgcgggctcttgaccccgactcaggtgttaacagtcgagtcacctttaccctgcttgctgggggtggtggagccttcaccgtggaccccaccacaggccatgtacggcttatgaggccttggctccccgattcaacagccctacctaccgtgtggacctgccctcaggcaccactgctggaactcaggtcctgcaagtgcaggcccaagcaccagatgggggccctatcacctatcaccttgcagcagagggagcaagtagcccctttggcctggagccacagagtgggtggctatgggtgcgggcagcactagaccgtgaggcccaggaattgtacatactgaaggtaatggcagtgtctgggtccaaagctgagttggggcagcagacaggcacagccaccgtgagggtcagcatcctcaaccagaatgaacacagtccccgcttgtctgaggatcccaccttcctggctgtggctgagaaccagcccccagggaccagcgtgggccgagtctttgccactgaccgagactcaggacccaatggacgtctgacctacagcctgcaacagctgtctgaagacagcaaggccttccgcatccacccccagactgtgggatcctcagacaagcgggactgtgttcattctggttgaggatg

SEQ ID NO: 72268 - DNA, 500 bp, Homo sapiens
tctcccacctagctgaaggtgtggggctctggccagccacttcattcctgagtcccttctggtctttccagggggtgtgttatcccatcacacactctcatggagcactcctagagccacctcctcactggttctggggtgggctggtaattaatactcatacttgctcccagaagcagagagtgtgagtatctcagattactccagggagaaggaagctccggaactgccagtggctcactcaaggctcacaggtggcagtgatatgagcagaacccagaaacctagcattccaggtgtatcgggagtcaccagcaccattctggggctgccatggagaagggcacagggatggccagccctcagccactgtattcttagacacagcagaatctacatggaaatgcagtgattgtgataggaggaaacggagctgggggaactcaatctccaaaaggataactggccaagtttgcgctgcggggactgctcagaaatga

SEQ ID NO: 72269 - DNA, 505 bp, Homo sapiens
aaaaaagaaaaggatggctaaaagatacaccaggcgaataataaccaggcgaataataaccagagtagctacactgacttttgataagatggactttcaaacagagatcattacacagataaaaaggattgcctaatgatggtagaaggttaatttcatcagcaagttaaattgtagaagagctcaaaatatgtaaaacaagcagatgaaactttacagagaaattcaaaacactacccttagtctggaagccctcttctctcaagagctaaacagaaaacgaatgaagatagagatttgaacacacttcttcatgtaagtatttgtttcctattgctgctgacacagtaccacatacttagtggcttaaaacaatgcaggctggtacactggctcacgcctcttatcccagcacttttagaggctgaggcaggagcatcacttgagtccagaagtttgagaccagcctgctcgacatagaaacaccctgcctctacaaaaaaaa

SEQ ID NO: 72270 - DNA, 243 bp, Homo sapiens
aactttctcatgcagtgtttgtggacctgatagtgttccctttcagagaggtgctctgcaccatgtcctcttgactatttcaatgttcaagtcaccatattcatttatccaatgagctcttttctatagtttttttgactcagagattgtggatgatataacatccttacagtttctcacagatgcaaatctctgcatttagcctgaaagtgactaagtgtactatgagtatgatatgaccta

SEQ ID NO: 72271 - DNA, 351 bp, Homo sapiens
tctttttctgcctggagctataaggtcataaacctgccactactggtcacaatcttcctcccataaaatgaaagtaagcctcagaataaagccagaacagaggcaggaaaaacagagacatcaggagagcagtggtcctgataacatcatttgagcccctgattccagatatacctgaagcctgtatatcccttggcttttagttctgttaagtaaaacttatggggatgccattggtttggactgagctcctgcgctgggccccaacagatcagaccaaaccagaatggagtcactcatgctagctgttacgtagtcaaactgaacttagaagtggatcagttttccaaa

SEQ ID NO: 72272 - DNA, 438 bp, Homo sapiens
aaaaaattttactagttccttaattataaatcatctgagagaaaattgcaacttggtatggacctcaccaaacccctcgccaattcaatcgggccctcctttgataatttaacaacaaattcctgtctggaatcatccattcaagtgcctttttaaatgaatcccatttcaattttttaataaagtgccaccagtagatctgcaagttgagaaaagcagctcaggtgacacacgtggcaccaaaaagattattgagtgggtcaaaaatcctgcctgggcacaaaatagaagaagagcctaagaaggtgactagacttagggacttcaagaagaacaagcactgaaaacagcagtttaactacctcggacagtaagcaacaagcctgcagtccccagataagcggcccagagggagctgaggggatggagttggaaagg

SEQ ID NO: 72273 - DNA, 697 bp, Homo sapiens
tccatcaatttgtaaagttttggctgggtgtagtggctccagcctgtaatcccagcactttaggaggccaaggtgggaggatcacttgaactcctgacctcaggtgatctgcccacttggcctcccaaagtgctgagattacaggtgtgagccaccacccctgctgtcacattttaaaaatatgcctgctatagaaaaatctacctgtgttataggttaccaaagtcacataggtgactttaaaggtttcaagtgagttactctaaaagagactatccactttttgaacagagagatgagattcctcaaagtacctcagtacacagtgagaattacattcccctttttccttctgtgcctgagcaacgagtcactttgagcctccatttctgttctcagccctaggttcagctggagagattcatgttttcccttgtgtttacagaccttaaatgcactgtcctttcaaaaatttttttttcctaagctgtagaaataaattcagtttcagtgatctccccagtcttaaaaaaacaaacaacatccctggaatcctcagaagtgatttcttggcatggtaatgtgtagttgattgtgctgggtccaacagtagactctgattaaggttgaaataaagaggaagtgagaacagggatgatttaattgctcacaagaaataaatctattggctagaaga

SEQ ID NO: 72274 - DNA, 337 bp, Homo sapiens
tgtgaggacatagggaaaagatgactgtctctaaaccaggaagtgagcgctcaccagatactgaatctgctggcaggctcctcaactacaagcaattcatttctgttgtttataagacactcagtctgtggtattttgttatagcagctcaaatagattaagaccttcaccttgtattttagaggccaaagtggataatgacttggggatatgatgggtaccactaagcctgtatcattgacgtcttcaagtatggtactaatctttgccattccccctagaagcagcattgttttttattttacaatcttccaaggatggtaagggaaatttaagg

SEQ ID NO: 72275 - DNA, 518 bp, Homo sapiens
aggccttaagaaacttacaatcatggtggaaggtgagagggaaggaaggaccttcttcacatggtgccaggagagagaggcagtgaaggggggaattatcacacacttttaaaccatcatatctcatgagagctcactcactattatgagaacagcaagggggaaatttccccccatgatccaatctcctcccaccagtctcctcctccaattcaacatgagatttgggtgggggcacaaatccaaatagattattgtaagtataatgaaatataagtgccatttatttatttaaaaaccattttttgagaacatactatgtactagacatggtactgtaactcttgttctgaggattgtatgaaaattatcatgttaaaattcatatgacaaaagaatgggtctacctcaagaagggtatgggaagctataaaaagaatggatatttgatctggaatttaaagatcaggtagaagaagcttgtcttaatggaaatagagataagacatgagagagtg

SEQ ID NO: 72276 - DNA, 4676 bp, Homo sapiens
ttctaatgcttttaaggttccttttcagcccttcctcctcgtaatccacaaatactgagaccaaggcattttttgggtcagtcctaatttcaagcattctatcctgccctccccaaatgaactcacacttattagaccatatgttcctatattagttcaggaagggggaaaaaatgttcatcacacttgtatataagagatcatagaaaaacagtttactaacctgtgaaaataccattcattctctgtttacctctggtccacagctaagcaatcagtaggatataaatgtaccctatgttcactattcagtattcataagtatactacttatgaattggaaatctgacacaacatttacatgacctaattttgaaaatttaaaatagtgtaaggcccctaggcttaattttacaggggaaagattaaaaggacacaagcaaacatatattctctctctgtgctgtgggacactggtaattttttgacttaaaatatttgatacttaaaatgccaaacttctacatttctgcagtaacaaggcagttatcatattgaataccatttctttctctccagtaagtaaatattagcacatgaactgaaaatattaagtgattataaaaaagtccaaataaattcattaaaatttagcttggcaaaatgttagtttcatgttcttggtagaagtccttttatatttatattcaaatgaaatgaacaatttacaagcaaaggaaatggcatcaaatatttgacaccctgcctcccaaggtgtattgattcatgctttttgctcagatctaggtttctccactcaggaaaagaggagaatgtacccatacttgggaaaacaagtttccgatggcacagctttgatcaaacagcaaaattctatccatctatgtattgccatctgacagtatgacaaatggtcccatgtgcgatattcacactgcattgtagtcaaacctgtaagtcaaaggatatgaaataatagtaactacacattaagcacagaagaaaatgaaacaaacaaaaaggttttaaaccaaccaaaaatatgtcttattttggatgttctatatgttcttacattctctcaggtcttttgtgtcgttatgaacacaattctaacaagcttgattattttatttccattcacatattacaggcaacaagctgaaaaagtagaacagggtgtagagagacaggacaaagtacagattagggcttgaagtgcccctgaccagtcgacagcaaccacatggaataatgactcatgtgcattaatgatcacactaaatgatatttgttttttacctagtccttcaactgacagcttaaagaacttcaggttgttctgattcttgagtctcctctacaacttcagagaggactttcattttattttggatcaaatgctccacaactagttgaaactggaattaaattttatatgaagttcctagatgatttaaagctgtaagaagaagaataatgaatcataagaaaacttgctgctacagatatcaaaaaggaatgttaccatccctcatgctaatccttttcattttaaataaacaggatctaaaaaaaataatgctgggaagtcctaaccacatcaagaatgcctcagatcagtgacccaaggaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttcaaaataaaacaagagatatttaagattcattaagttcttgtcatttcaaattttaagaaaaatattttctaatggaattacatatatttatatgattcttctagttatatccatggtaataaatactcttttcagttggaaataaaacccatttgtgctatattattagggaaaatatctacataaattagtttttaatttaactaaagtctatcttttgaattcataagcataaaattttaaccacttgcaaaatttataacacacttaaggtagtcagatgccttgtcaagtagtttaacaaaagtgattttcacctgtttgttttaataacagtgcatcgattttatgaaaatcaggcatgccctcgggtcctaacaaagtatacgaagctgaatggatctatgccaaatatgccagattttactttctgagtctgattttatacttctgtcctctttcttaccacatggcttccagtatcacttacagactaacccttcaaaaggagaaggctaagttactaacatttggaaggcttatgaaagtgaagcatagttatgagccagcaatgtttttatttagggaatgtgtgcaaaccacacacttaagcaagctctggggaatgagagttggggggaatcaactgttttatttgctaattggtatttcctttaaaagatagagttcttccagattttaactgtgttaatagttactctagaaaaattggagatttgtgtgcatatattttatgttgtaaacagacacatacccagagacactgagagagacagacagacagtaaacagaggagcactaaccacaaacggtttacaaatgacctctgtgctcattcacctgtctgttccccaccttgccttttatagcaactatagcaacagccatgagagtcattgtggaaagaaataaaataaaattaaaaaatcctggaagcttgtaaagaatgtgagcaaaggggaggaagttgtgaaaaaaatgaataaagggcaccgatccagagtattgaagaaggcagagtggagagcctagtaatgagtatctggtaccccagtatcctctcccacagaatctgtacagctctccgtttatgacagtttaaacttaatttaaattatcaaacagacactttcctcaaacatataaatgatgaggcagttcattcaggctgtatgtataaagttgttccagccacctttttctaacggcttctctatatcttttacatggagacaatgagagatttgcttaggacaatttgactgtaatttagaagtaggaaatgggaagtatttgtatcttctttgcctaactcacattagttactcaagtaagcatttcttccgttattgcattttcctgattacaagttttatgttttctctaaaacacatatcaaaagaaatgtcctaagcactatgcagggggaagccatgacatttatccaccactgtcagcaaaaacatgaacttagccctcaacagaatatttcacttcattctagtgtcacctctgcgtcacctgcactggagtcaccacttgcctgttgggtaagaccaggatgcaccgctgaaataaaaaggggtcagacaatacaagaaaagccagtagaaattgccaaatgtatcagaatacacacaggctttctaaggatatggcccaagaggaaggctctagagcccaccctgaaacaggatttttgacttcacagagaaattatttaattttcaataacacaattcaattaaagaaagggaaatacaaggctaaacaaataagaaatgaagacaaaaacccaacctttcaaatctaaagaaaataatctgttttaaagacacagatgaagatcaggaacccaaaacagaagaaaggaaaagcaattaacgctggcatctgataacaacgaaaagtatggagtctggagaatcgctagactctaaaaattataaaggtttagacttggactttgtacactgaagaaaagaaaactgcatgcatttatactgaccaatgtacactattgctgctttttaacttttgtgtatatgtagggtagatttttttttaagtgaaagcaagcttattaagaaagtaaaagaataaaaaggtgacttctccataggcagaaaactagcgtagtttttttattagaaattgttattcaataatagtacatgttacaaataaataccattttaaactgaaaaaattgtagactttcaaatcagttagggtggtcaccctaaaaaagggcatttttttccccttagtctccttgttcatgttgctcacaacaagaaatgggctaatgctatgaataataataacaaacactgccttctgtcaggccctgtgctgaataccgtctgcatatgtataggaaagggttaactcagcaggtcttgtttgcccagactctgtacatttccaagaaaggtctgcctttaggactggtccttggccagctcctggagaatgagctctcagcttttagaaaattctatctgctaagaatagttttgcatgtctcaggtcttgggccacaaaatatcagtttaatcagatggtttatgttaacaagtatgatttatggcaaacatagatctctaatctccatttctctctcatatatctatatttatctatccatatatatgtacctatatatatcaaatataaagatatgtttatagcaattgtatatacgtagagagataatatgtagtatgaagagagacatagatattattcttcattttagaatgttatcttggtatgtttaaaaggaaaaacttaagatgtgttgcaattgcagatgagttcaggttgtcctgtatgtgtgttatgtgtg

SEQ ID NO: 72277 - DNA, 3114 bp, Homo sapiens
ctgaggccctggcccagagggacaagatctaaaaaaaataatgctgggaagtcctaaccacatcaagaatgcctcagatcagtgacccaaggaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttcaaaataaaacaagagatatttaagattcattaagttcttgtcatttcaaattttaagaaaaatattttctaatggaattacatatatttatatgattcttctagttatatccatggtaataaatactcttttcagttggaaataaaacccatttgtgctatattattagggaaaatatctacataaattagtttttaatttaactaaagtctatcttttgaattcataagcataaaattttaaccacttgcaaaatttataacacacttaaggtagtcagatgccttgtcaagtagtttaacaaaagtgattttcacctgtttgttttaataacagtgcatcgattttatgaaaatcaggcatgccctcgggtcctaacaaagtatacgaagctgaatggatctatgccaaatatgccagattttactttctgagtctgattttatacttctgtcctctttcttaccacatggcttccagtatcacttacagactaacccttcaaaaggagaaggctaagttactaacatttggaaggcttatgaaagtgaagcatagttatgagccagcaatgtttttatttagggaatgtgtgcaaaccacacacttaagcaagctctggggaatgagagttggggggaatcaactgttttatttgctaattggtatttcctttaaaagatagagttcttccagattttaactgtgttaatagttactctagaaaaattggagatttgtgtgcatatattttatgttgtaaacagacacatacccagagacactgagagagacagacagacagtaaacagaggagcactaaccacaaacggtttacaaatgacctctgtgctcattcacctgtctgttccccaccttgccttttatagcaactatagcaacagccatgagagtcattgtggaaagaaataaaataaaattaaaaaatcctggaagcttgtaaagaatgtgagcaaaggggaggaagttgtgaaaaaaatgaataaagggcaccgatccagagtattgaagaaggcagagtggagagcctagtaatgagtatctggtaccccagtatcctctcccacagaatctgtacagctctccgtttatgacagtttaaacttaatttaaattatcaaacagacactttcctcaaacatataaatgatgaggcagttcattcaggctgtatgtataaagttgttccagccacctttttctaacggcttctctatatcttttacatggagacaatgagagatttgcttaggacaatttgactgtaatttagaagtaggaaatgggaagtatttgtatcttctttgcctaactcacattagttactcaagtaagcatttcttccgttattgcattttcctgattacaagttttatgttttctctaaaacacatatcaaaagaaatgtcctaagcactatgcagggggaagccatgacatttatccaccactgtcagcaaaaacatgaacttagccctcaacagaatatttcacttcattctagtgtcacctctgcgtcacctgcactggagtcaccacttgcctgttgggtaagaccaggatgcaccgctgaaataaaaaggggtcagacaatacaagaaaagccagtagaaattgccaaatgtatcagaatacacacaggctttctaaggatatggcccaagaggaaggctctagagcccaccctgaaacaggatttttgacttcacagagaaattatttaattttcaataacacaattcaattaaagaaagggaaatacaaggctaaacaaataagaaatgaagacaaaaacccaacctttcaaatctaaagaaaataatctgttttaaagacacagatgaagatcaggaacccaaaacagaagaaaggaaaagcaattaacgctggcatctgataacaacgaaaagtatggagtctggagaatcgctagactctaaaaattataaaggtttagacttggactttgtacactgaagaaaagaaaactgcatgcatttatactgaccaatgtacactattgctgctttttaacttttgtgtatatgtagggtagatttttttttaagtgaaagcaagcttattaagaaagtaaaagaataaaaaggtgacttctccataggcagaaaactagcgtagtttttttattagaaattgttattcaataatagtacatgttacaaataaataccattttaaactgaaaaaattgtagactttcaaatcagttagggtggtcaccctaaaaaagggcatttttttccccttagtctccttgttcatgttgctcacaacaagaaatgggctaatgctatgaataataataacaaacactgccttctgtcaggccctgtgctgaataccgtctgcatatgtataggaaagggttaactcagcaggtcttgtttgcccagactctgtacatttccaagaaaggtctgcctttaggactggtccttggccagctcctggagaatgagctctcagcttttagaaaattctatctgctaagaatagttttgcatgtctcaggtcttgggccacaaaatatcagtttaatcagatggtttatgttaacaagtatgatttatggcaaacatagatctctaatctccatttctctctcatatatctatatttatctatccatatatatgtacctatatatatcaaatataaagatatgtttatagcaattgtatatacgtagagagataatatgtagtatgaagagagacatagatattattcttcattttagaatgttatcttggtatgtttaaaaggaaaaacttaagatgtgttgcaattgcagatgagttcaggttgtcctgtatgtgtgttatgtgtg

SEQ ID NO: 72278 - DNA, 2283 bp, Homo sapiens
ttctaatgcttttaaggttccttttcagcccttcctcctcgtaatccacaaatactgagaccaaggcattttttgggtcagtcctaatttcaagcattctatcctgccctccccaaatgaactcacacttattagaccatatgttcctatattagttcaggaagggggaaaaaatgttcatcacacttgtatataagagatcatagaaaaacagtttactaacctgtgaaaataccattcattctctgtttacctctggtccacagctaagcaatcagtaggatataaatgtaccctatgttcactattcagtattcataagtatactacttatgaattggaaatctgacacaacatttacatgacctaattttgaaaatttaaaatagtgtaaggcccctaggcttaattttacaggggaaagattaaaaggacacaagcaaacatatattctctctctgtgctgtgggacactggtaattttttgacttaaaatatttgatacttaaaatgccaaacttctacatttctgcagtaacaaggcagttatcatattgaataccatttctttctctccagtaagtaaatattagcacatgaactgaaaatattaagtgattataaaaaagtccaaataaattcattaaaatttagcttggcaaaatgttagtttcatgttcttggtagaagtccttttatatttatattcaaatgaaatgaacaatttacaagcaaaggaaatggcatcaaatatttgacaccctgcctcccaaggtgtattgattcatgctttttgctcagatctaggtttctccactcaggaaaagaggagaatgtacccatacttgggaaaacaagtttccgatggcacagctttgatcaaacagcaaaattctatccatctatgtattgccatctgacagtatgacaaatggtcccatgtgcgatattcacactgcattgtagtcaaacctgtaagtcaaaggatatgaaataatagtaactacacattaagcacagaagaaaatgaaacaaacaaaaaggttttaaaccaaccaaaaatatgtcttattttggatgttctatatgttcttacattctctcaggtcttttgtgtcgttatgaacacaattctaacaagcttgattattttatttccattcacatattacaggcaacaagctgaaaaagtagaacagggtgtagagagacaggacaaagtacagattagggcttgaagtgcccctgaccagtcgacagcaaccacatggaataatgactcatgtgcattaatgatcacactaaatgatatttgttttttacctagtccttcaactgacagcttaaagaacttcaggttgttctgattcttgagtctcctctacaacttcagagaggactttcattttattttggatcaaatgctccacaactagttgaaactggaattaaattttatatgaagttcctagatgatttaaagctgtaagaagaagaataatgaatcataagaaaacttgctgctacagatatcaaaaaggaatgttaccatccctcatgctaatccttttcattttaaataaacaggatctaaaaaaaataatgctgggaagtcctaaccacatcaagaatgcctcagatcagtgacccaaggaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttcaaaataaaacaagagatatttaagattcattaagttcttgtcatttcaaattttaagaaaaatattttctaatggaattacatatatttatatgattcttctagttatatccatggtaataaatactcttttcagttggaaataaaacccatttgtgctatattattagggaaaatatctacataaattagtttttaatttaactaaagtctatcttttgaattcataagcataaaattttaaccacttgcaaaatttataacacacttaaggtagtcagatgccttgtcaagtagtttaacaaaagtgattttcacctgtttgttttaataacagtgcatcgattttatgaaaatcaggcatgccctcgggtcctaacaaagtatacgaagctgaatggatctatgccaaatatgccagattttactttctgagtctgattttatacttctggtgtgacaattgaccgggatcctcta

SEQ ID NO: 72279 - DNA, 1576 bp, Homo sapiens
  misc_feature (16)..(16): n is a, c, g, or t
  misc_feature (123)..(123): n is a, c, g, or t
  misc_feature (674)..(674): n is a, c, g, or t
  misc_feature (1127)..(1127): n is a, c, g, or t
  misc_feature (1174)..(1174): n is a, c, g, or t
ggctcgctgacctacngggtgccagagaggctgcggcagggtttctgtggcgtgggtcgggcagcacaggccttggtgtgtgcgagtgccaaggagggcaccgccttcaggatggaggctgtncaggagggggcggccggggtggagagtgagcaggcggctttgggggaggaggcggtgctgctgttggatgacataatggcggaggtggaggtggtggcggaggaggagggcctcgtggagcggcgggaggaggcccagcgcacagcaggctgtgctggccctgggccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttgtatccttctcagtgtttcttcggcctttctagtggagaggtgctctcggggaagtgtaagtgaccgatgggcagctcggcgtcgatgtgactctttggggaacaaaggggagttgccacggaccaatgtggctgtggaaagccggagcaggctgggtactattgtcctgcatgcggcagagaaacccttggtgatgccgagcngcagacgtttggggcatctttttgaagagcagaagcgagttcagagcggaagaggtttttcagtgaatgaagctatttttaagggagtgtgattgctgccccttgctagtccgatctgggactgggcgtcttcggctataagcagattctgccactcctcagacaccagcaagtctctgcaaatcgcgcctccccatgtcagtgcagtcagcctcagaatcatacaccctctgtgaacacaggaggccttagtttacggggacggggaggcgaaaggagatcatacatggaagcagatctgagaatccctacccagcctctggtgctcttaggccttcttccctgttgctcctcgctttcccttccatcgtgtgtaaagtctctttgacctaaatcagattgcaaaccacccccagatgtcagccctgatcactgacgaagatgaagacatgntgagctacatggtcagcctggaggtgaggccaggaagactggggctngagggtttagcgggggagggtaagggaaataattcattcctgtaagcaagagtgagcacctcacccgaaaacctatctaagctttctccaccttgtcctgacaggtggaagaagagaagcatcctgttcatctctgcaagatcatgttgttctttcggagtaacccctacttccagaataaagtgattaccaaggaatatctggtgaacatcacaggtgacaggtggctcccaggatgggtagtggaaggaagatgggtagtggaaggaagatggtgggtggatcattgccaacgggatccagcccccttcccacaaaaactcctgtctctgtagaatacagggcttctcattccactccaattgagtggtatccggattatgaagtggaggcctatcgccg

SEQ ID NO: 72280 - DNA, 408 bp, Homo sapiens
tgtagataacattgttggattttggaacagatggaccaagaacttaaaataagcatgataatatgtttaagaaacttaggaattcagaatggtatattttatctggtttttgtccatctttgatacagttgtatgtactctttgagtgattaattattttggttcatgagtttgtttttcctggggttttcagctactctgtttggttatgtatattggggaaataatggaaatccaagttcgattcaagttcttgtctgcttctgagaggagggtgatccccaggcaacacaaaatcagcattgatcattcctgattgctgtcattttaccatgtaacaacactggacacagttgtactttgaaactcctagacagtagtggaaggagaccttcttttaaaattata

SEQ ID NO: 72281 - DNA, 367 bp, Homo sapiens
tcattttcatttttttccctcattttattctcagtctatgccatccactgatcttgaccacatttaaaagaagaagaaagtgagatagggaaaataggcagctttgtttggctgaaagagaagagctcaatttgaatgcctactgtgtgtccctatttttatagattaggcaactgatactagaagaggtgaggtaatttaccatggttgcatagcacattaggacagggtgcatatcaacatttttgtacagcaaagtctattctctgtgctaaaagcttgctgcttctgtaattccaaatttcattgaccctaagagactgcttattgtaaattgtgtctttaagtgctgtaaagaaagaaagga

SEQ ID NO: 72282 - DNA, 493 bp, Homo sapiens
atgatcagcctggaagggttgggctagggggtagtgatgaaacatggctggatggaagtgttctgggtatgtggtcttctgctgtccctggcatctctaacttaccaggcccttgtattctttttctgacctcagcaccctttgaccaacagcctagggggagatgccgtgctgcttgctgtttggaagaagtgagaggaaggggtccacctgaccattctccatgtggttcatgaagctgcccaagatccctacagctgccacttcttatcctgagtacttctataaccactgccatttttcccaaacagggtttggcctgtaattttctccatcaatcagatttttatgtcatctttcccttaggatttctgaactatcaatgaatgatacacattcttgtttcccaatatgctgatgtagacttcagtatctttctctctcagtatttggacaggaggaggcggcacacccatatgcccaggctatcatc

SEQ ID NO: 72283 - DNA, 324 bp, Homo sapiens
  misc_feature (250)..(250): n is a, c, g, or t
  misc_feature (277)..(277): n is a, c, g, or t
  misc_feature (311)..(311): n is a, c, g, or t
cagcctggatctcgctgcttcttatcacgaccactgctgccacaccacccagccaccagtcccagcctggtgtgcagcaacccccagagaccaccggactcagcggccagtgtgagccccactgtcggagcagtccctgtggcactagtccagaagcacttctgttcagggtgcccatctagctgggtattgaagagcttggcaggaacagcgggctcaccactcctcaaggttaacaatagatgaaatnagatctgatgacttaagtgggcttttnttgtccttccagattttcacaaaagccgtctttngtggggtttttat

SEQ ID NO: 72284 - DNA, 1321 bp, Homo sapiens
atgttgtgaggaagcctaggccacatggagaggccacatagatgtgttccaggcagcagccccagcaaaggtctcaatcaaccaccatatgtgtgagtgaaggaaccttcagataattttgcttcccagacttcaagtctttcagctggggtccaagacatcacaaggcagagacaagccctcctggaattccccacccaccgtgagcataagaaaacttgaaagcggtgtaaatggctcttatctgaaccacaatgaattcacatattcaagttggcttcttcggaaatttcaggccacaaatggcagtgatgcgaccaggagcagtaacacgattacaagtcgcaatttaggaagggtgctccatcatcatttcatgattctcactacagcccagacagggctgagctgtagatccacggccaccatgatgagctaagagtttctggattcagtgcctgctgttgctcctggagatttgtatcctgattgaaggctggttccatatctgttcacccagtcacctttaaaattaagtcctgggcacaaatcattagtctggcaagttacatcactgtgccacttccatccggacagaaggaacccaggtcaaggctgacaggaggagcaggagccgtcaatgagagcagacctcagaagccaacggaggtgagaagagcaccatccacagccccatcctctgaatgctgtgggaagaagtccacaaaataccaccccttggagtcagtcagtagtagagcccttgctgctggctgcaaataccccatcagaacatgtttggggtgattcttggacctggtttcaatttcttttctgccagtcagcagttgtgcttgactcacaatttgttgccatctcttgaattaaactcaggaaacaggataaagatcagaaccacattgtaaaagcttccttatggttcattttttgctgagataaataatgagcagctctgatccatgtctctggagagctcagagcacactaccaggagctcctagccacagggtgagcacaggtggctggtgttctcttgatgaggaaagacagcagtgtccaatctaccctgccttacacggagccccaggtgctctcccggactgtgttgctacctaaagcacatggcaattgcatgatgctaaccagagcagcccctcactcattagaaacatctgctttgcattatttacacaggcaaagttttcctttttactgagcctacccagttcaaacttaagtgggatttgccagctatctggctaattttatgagcaataataaagattggtgaacacttggt

SEQ ID NO: 72285 - DNA, 1630 bp, Homo sapiens
agcattacatgttattcttaacacctgccacttctctcttcccacctctatctgccttattgaacttcatctttccttcattctcttcaacttccacttcttcttgtatggtcctgttgatgccatcttgtttccgtccccagactcatcatctttaccctctgtcaactgagttcccaccctggttctctctcaagatcttcctctcatagctttcacccttggtaaacaatgaggacacatctcaaaaagaatgatgtaatttaattgccttgagttggctgggccatcatctattataaagtgctcttaaaattaaagctaatttaattctgaagaactaaggattaagaagttaagagctggggttcttacaatatggcttgcagactacaagtgtgaactgaggaggtccccaaagtcacttcttactaagtgaaagcggtgtaaatggctcttatctgaaccacaatgaattcacatattcaagttggcttcttcggaaatttcaggccacaaatggcagtgatgcgaccaggagcagtaacacgattacaagtcgcaatttaggaagggtgctccatcatcatttcatgattctcactacagcccagacaggtgggcagagcagtgttctttcccctttaatgaatgaagaagctgagcctcaaacagatgagggggcttcctgggttcacagagctctaaagggctgagctgtagatccacggccaccatgatgagctaagagtttctggattcagtgcctgctgttgctcctggagatttgtatcctgattgaaggctggttccatatctgttcacccagtcacctttaaaattaagtcctgggcacaaatcattagtctggcaagttacatcactgtgccacttccatccggacagaaggaacccaggtcaaggctgacaggaggagcaggagccgtcaatgagagcagacctcagaagccaacggaggtgagaagagcaccatccacagccccatcctctgaatgctgtgggaagaagtccacaaaataccaccccttggagtcagtcagtagtagagcccttgctgctggctgcaaataccccatcagaacatgtttggggtgattcttggacctggtttcaatttcttttctgccagtcagcagttgtgcttgactcacaatttgttgccatctcttgaattaaactcaggaaacaggataaagatcagaaccacattgtaaaagcttccttatggttcattttttgctgagataaataatgagcagctctgatccatgtctctggagagctcagagcacactaccaggagctcctagccacagggtgagcacaggtggctggtgttctcttgatgaggaaagacagcagtgtccaatctaccctgccttacacggagccccaggtgctctcccggactgtgttgctacctaaagcacatggcaattgcatgatgctaaccagagcagcccctcactcattagaaacatctgctttgcattatttacacaggcaaagttttcctttttactgagcctacccagttcaaacttaagtgggatttgccagctatctggctaattttatgagcaataataaagattggtgaacacttggt

SEQ ID NO: 72286 - DNA, 1078 bp, Homo sapiens
atgttgtgaggaagcctaggccacatggagaggccacatagatgtgttccaggcagcagccccagcaaaggtctcaatcaaccaccatatgtgtgagtgaaggaaccttcagataattttgcttcccagacttcaagtctttcagctggggtccaagacatcacaaggcagagacaagccctcctggaattccccacccaccgtgagcataagaaaacttgaaagcggtgtaaatggctcttatctgaaccacaatgaattcacatattcaagttggcttcttcggaaatttcaggccacaaatggcagtgatgcgaccaggagcagtaacacgtgccacttccatccggacagaaggaacccaggtcaaggctgacaggaggagcaggagccgtcaatgagagcagacctcagaagccaacggaggtgagaagagcaccatccacagccccatcctctgaatgctgtgggaagaagtccacaaaataccaccccttggagtcagtcagtagtagagcccttgctgctggctgcaaataccccatcagaacatgtttggggtgattcttggacctggtttcaatttcttttctgccagtcagcagttgtgcttgactcacaatttgttgccatctcttgaattaaactcaggaaacaggataaagatcagaaccacattgtaaaagcttccttatggttcattttttgctgagataaataatgagcagctctgatccatgtctctggagagctcagagcacactaccaggagctcctagccacagggtgagcacaggtggctggtgttctcttgatgaggaaagacagcagtgtccaatctaccctgccttacacggagccccaggtgctctcccggactgtgttgctacctaaagcacatggcaattgcatgatgctaaccagagcagcccctcactcattagaaacatctgctttgcattatttacacaggcaaagttttcctttttactgagcctacccagttcaaacttaagtgggatttgccagctatctggctaattttatgagcaataataaagattggtgaacacttggt

SEQ ID NO: 72287 - DNA, 1835 bp, Homo sapiens
agcattacatgttattcttaacacctgccacttctctcttcccacctctatctgccttattgaacttcatctttccttcattctcttcaacttccacttcttcttgtatggtcctgttgatgccatcttgtttccgtccccagactcatcatctttaccctctgtcaactgagttcccaccctggttctctctcaagatcttcctctcatagctttcacccttggtaaacaatgaggacacatctcaaaaagaatgatgtaatttaattgccttgagttggctgggccatcatctattataaagtgctcttaaaattaaagctaatttaattctgaagaactaaggattaagaagttaagagctggggttcttacaatatggcttgcagactacaagtgtgaactgaggaggtccccaaagtcacttcttactaagttcagataggtgatggattgaaaataatcccaatattccacaagcaacatcaacatcccccacacacccagcaccgaggaataccctcctctctagaatgtgaggccactgtgtggaggaagacaccacggtgctctactgagccatgaaagtcacgcctgacctaaacagaagactacgtcccctggctaaaagaggaaatagttgaaagcggtgtaaatggctcttatctgaaccacaatgaattcacatattcaagttggcttcttcggaaatttcaggccacaaatggcagtgatgcgaccaggagcagtaacacgattacaagtcgcaatttaggaagggtgctccatcatcatttcatgattctcactacagcccagacaggtgggcagagcagtgttctttcccctttaatgaatgaagaagctgagcctcaaacagatgagggggcttcctgggttcacagagctctaaagggctgagctgtagatccacggccaccatgatgagctaagagtttctggattcagtgcctgctgttgctcctggagatttgtatcctgattgaaggctggttccatatctgttcacccagtcacctttaaaattaagtcctgggcacaaatcattagtctggcaagttacatcactgtgccacttccatccggacagaaggaacccaggtcaaggctgacaggaggagcaggagccgtcaatgagagcagacctcagaagccaacggaggtgagaagagcaccatccacagccccatcctctgaatgctgtgggaagaagtccacaaaataccaccccttggagtcagtcagtagtagagcccttgctgctggctgcaaataccccatcagaacatgtttggggtgattcttggacctggtttcaatttcttttctgccagtcagcagttgtgcttgactcacaatttgttgccatctcttgaattaaactcaggaaacaggataaagatcagaaccacattgtaaaagcttccttatggttcattttttgctgagataaataatgagcagctctgatccatgtctctggagagctcagagcacactaccaggagctcctagccacagggtgagcacaggtggctggtgttctcttgatgaggaaagacagcagtgtccaatctaccctgccttacacggagccccaggtgctctcccggactgtgttgctacctaaagcacatggcaattgcatgatgctaaccagagcagcccctcactcattagaaacatctgctttgcattatttacacaggcaaagttttcctttttactgagcctacccagttcaaacttaagtgggatttgccagctatctggctaattttatgagcaataataaagattggtgaacacttggt

SEQ ID NO: 72288 - DNA, 1151 bp, Homo sapiens
agcattacatgttattcttaacacctgccacttctctcttcccacctctatctgccttattgaacttcatctttccttcattctcttcaacttccacttcttcttgtatggtcctgttgatgccatcttgtttccgtccccagactcatcatctttaccctctgtcaactgagttcccaccctggttctctctcaagatcttcctctcatagctttcacccttggtaaacaatgaggacacatctcaaaaagaatgatgtaatttaattgccttgagttggctgggccatcatctattataaagtgctcttaaaattaaagctaatttaattctgaagaactaaggattaagaagttaagagctggggttcttacaatatggcttgcagactacaagtgtgaactgaggaggtccccaaagtcacttcttactaagttcagataggtgatggattgaaaataatcccaatattccacaagcaacatcaacatcccccacacacccagcaccgaggaataccctcctctctagaatgtgaggccactgtgtggaggaagacaccacggtgctctactgagccatgaaagtcacgcctgacctaaacagaagactacgtcccctggctaaaagaggaaatagttgaaagcggtgtaaatggctcttatctgaaccacaatgaattcacatattcaagttggcttcttcggaaatttcaggccacaaatggcagtgatgcgaccaggagcagtaacacgattacaagtcgcaatttaggaagggtgctccatcatcatttcatgattctcactacagcccagacaggtgggcagagcagtgttctttcccctttaatgaatgaagaagctgagcctcaaacagatgagggggcttcctgggttcacagagctctaaaggtgggaacctagctttttcagtgacattagctagatgtggtgggcacttctcactagaaaaacaagaattaaatcaacgtgaggtccagaactggtgtcccctgttggaaaaataaattgaaactaatgttctggcaataggtagcaaaaactttaaacctatggtaccatctgtcttgacaatcttacctctagaaattgaccccttaataaattaaaactgtgtctttattagc

SEQ ID NO: 72289 - DNA, 360 bp, Homo sapiens
aaccaacctgtaggtaactttgtttccttaaccttggtgtctgtcttagttgatacagcggtgtttattttgatctttcagattacaagtcgcaatttaggaagggtgctccatcatcatttcatgattctcactacagcccagacaggtgggcagagcagtgttctttcccctttaatgaatgaagaagctgagcctcaaacagatgagggggcttcctgggttcacagagctctaaaggtgggaacctagctttttcagtgacattagctagatgtggtgggcacttctcactagaaaaacaagaattaaatcaacgtgaggtccagaactggtgtcccctgttggaaaaataaattg

SEQ ID NO: 72290 - DNA, 757 bp, Homo sapiens
ttattgctctcagcacctctgcaacattgggaaattagagagtatttttttacagatgagaaaactcaggcccaaagaggttaagaaacttggccaaggttatacaataagttaggaggaaaggagtacttaaatttgcattttctttctccagatccagtgctcactttgggactccgctgctgccaatattatttcagacgtttcccattaacaatacacatcaggtgaccagaaatcctggtttgcccaggaatgtgctggcttactcctgttttcctggcttaattattaaaagcacccgccttgactctcagaagtgtcttggtttgggtgataagtgatatggtcccccgagctgtatggcaagcccagagttggttttcagtaaatgcttgactgaatcactgtttggagattctcacacctgattttgatatgatcccatttcttttgcttgtgtgtgggttggcagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaagtaagagtgccatcagtgtctcgcctctcagccccagtactttttctcatccctctgttaagaacaggtagatctatgacagagagaacaggatgaggaatggcaaagcctgcc

SEQ ID NO: 72291 - DNA, 1488 bp, Homo sapiens
actattgggacgctgcggcctggccttcaggccactggctaccgaaccccggggctcttcaccagtccagctcgtttccagcaccatgtcggtgcggacgctaccgctgctcttcttgaacttgggcggggagatgctttacatcctcgaccaacggctgcgggcccagaacatcccgggagacaaggcccgcaaagttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaaatatatggtggtctctctgcaggggagttccagctgatccggcagacactcctcatcttcttccaagacctgcacatccgagtatccatgtttctaaaggacaaagttcagaataataacggtcgctttgtgttgccggtgtccgggcctgttccttggggaactgaagttccaggactcatcagaatgttcaacaacaaaggtgaagaagtgaagaggatagaattcaagcatggtggaaactatgtccctgcacccaaagaaggttcttttgaactttatggagaccgagtcctgaaactgggaactaacatgtacagcgtgaatcagcctgtggaaactcatgtgtctggatcatcaaagaacttagcctcatggacccaggaaagcattgctccaaaccctcttgctaaagaagagctgaatttcttggccaggctgatgggagggatggagattaagaaacccagtggccctgagcccggattccggttgaatctctttaccaccgatgaagaagaggaacaagcagcgctaaccaggccagaagagttatcctatgaagttatcaacatacaagccacccaggaccagcaacggagcgaggagctggctcgaatcatgggggagtttgagatcacggagcagccaaggctgagcaccagcaaaggggacgatttgctcgccatgatggatgagttatagctgttctgaccaggcgtcctctgcccccagggagaggctgctggatggtgacccctggggaatgccccatggcccagaatgatgctgctagttttctactgagtgaagccattacgtctatttcttatttatgttgtaaggaactgtgtgagtctcccttgaggagcactcactcttgaaggcacacacatacacatattttcagtgaaatatattctgacttttaaacttgaaaaaaaaaataaataaaacataaaaaaggg

SEQ ID NO: 72292 - DNA, 2057 bp, Homo sapiens
actattgggacgctgcggcctggccttcaggccactggctaccgaaccccggggctcttcaccagtccagctcgtttccagcaccatgtcggtgcggacgctaccgctgctcttcttgaacttgggcggggagatgctttacatcctcgaccaacggctgcgggcccagaacatcccgggagacaaggcccgcaaagttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaaatatatggtggtctctctgcaggggagttccagctgatccggcagacactcctcatcttcttccaagacctgcacatccgagtatccatgtttctaaaggacaaagttcagaataataacggtcgctttgtgttgccggtgtccgggcctgttccttggggaactgaagttccaggactcatcagaatgttcaacaacaaaggtgaagaagtgaagaggatagaattcaagcatggtggaaactatgtccctgcacccaaagaaggttcttttgaactttatggagaccgagtcctgaaactgggaactaacatgtacagcgtgaatcagcctgtggaaactcatgtgtctggatcatcaaagaacttagcctcatggacccaggaaagcattgctccaaaccctcttgctaaagaagagctgaatttcttggccaggctgatgggagggatggagattaagaaacccagtggccctgagcccggattccggttgaatctctttaccaccgatgaagaagaggaacaagcagcgctaaccaggccagaagagttatcctatgaagttatcaacatacaagccacccaggaccagcaacggagcgaggagctggctcgaatcatgggggagtttgagatcacggagcagccaaggctgagcaccagcaaaggggacgatttgctcgccatgatggatgagttatagctgttctgaccaggcgtcctctgcccccagggagaggctgctggatggtgacccctggggaatgccccatggcccagaatgatgctgctagttttctactgagtgaagccattacgtctatttcttatttatgttgtaaggaactgtgtgagtctcccttgaggagcactcactcttgaaggcacacacatacacatattttcagtgaaatatattctgacttttaaacttgacctttcccattttattcttaattgctgaggcaggagaatcgcttgaacccaggaggtagaggttgcagtgagccaagatcatgccattgcactccagcctgggcaacaagagcgaaactctgtctcaattaaaaaaaaaaaaaagaatataaatcaccaaataaatgttaattgctccctacccattaaagttacacttccttacctataaagacaccctccccctccacatactcacgaaaagtctgttggggaggagaagcatattgtgctataaaacacctgttgcatcagatgtacaaagtgcctttcgttttagtctcttttcagcaatctggccaccattcaggggggcctgactgggtgacagatgaatgggaaggttctgacctgttttgagtccggctcccaccttgctgtcacatatcagaatgtcactgctctgagtgtgtcccagggccttggaggtgggccgtgaggtgccgagaagcagccgcagcctcctccctccacctatcccagagcgatgctggtgatttcaaacgtatctgtcctatcagtaaataaacaagatgcagatctctggtatgacagctcca

SEQ ID NO: 72293 - DNA, 1388 bp, Homo sapiens
actattgggacgctgcggcctggccttcaggccactggctaccgaaccccggggctcttcaccagtccagctcgtttccagcaccatgtcggtgcggacgctaccgctgctcttcttgaacttgggcggggagatgctttacatcctcgaccaacggctgcgggcccagaacatcccgggagacaaggcccgcaaagttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaaatatatggtggtctctctgcaggggagttccagctgatccggcagacactcctcatcttcttccaagacctgcacatccgagtatccatgtttctaaaggacaaagttcagaataataacggtcgctttgtgttgccggtgtccgggcctgttccttggggaactgaagttccaggactcatcagaatgttcaacaacaaaggtgaagaagtgaagaggatagaattcaagcatggtggaaactatgtccctgcacccaaagaaggttcttttgaactttatggagaccgagtcctgaaactgggaactaacatgtacagcgtgaatcagcctgtggaaactcatgtgtctggatcatcaaagaacttagcctcatggacccaggaaagcattgctccaaaccctcttgctaaagaagagctgaatttcttggccaggctgatgggagggatggagattaagaaacccagtggccctgagcccggattccggttgaatctctttaccaccgatgaagaagaggaacaagcagcgctaaccaggccagaagagttatcctatgaagttatcaacatacaagccacccagtctcttttcagcaatctggccaccattcaggggggcctgactgggtgacagatgaatgggaaggttctgacctgttttgagtccggctcccaccttgctgtcacatatcagaatgtcactgctctgagtgtgtcccagggccttggaggtgggccgtgaggtgccgagaagcagccgcagcctcctccctccacctatcccagagcgatgctggtgatttcaaacgtatctgtcctatcagtaaataaacaagatgcagatctctggtatgacagctcca

SEQ ID NO: 72294 - DNA, 1114 bp, Homo sapiens
actattgggacgctgcggcctggccttcaggccactggctaccgaaccccggggctcttcaccagtccagctcgtttccagcaccatgtcggtgcggacgctaccgctgctcttcttgaacttgggcggggagatgctttacatcctcgaccaacggctgcgggcccagaacatcccgggagacaaggcccgcaaagatgaatggacagaggtggacagaaaacgagttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaaatatatggtggtctctctgcaggggagttccagctgatccggcagacactcctcatcttcttccaagacctgcacatccgaagagagtgcttctggaagcatatgcaagaaactgttcacagtgcacagtgttgccttccaggagtggggaactatatggaggacaggagaaggagactgactttccatcatgtatacccttttgagaactttgagttttgtacctgggcaaaataaaattttaaaaaggggaagaaaaaaaaaaaaaaaaaaaaaaaaaaaaaaaaaaaaaaaaaaaaaaaaaaaaaaaaaaaaaataaagggggggaaaaataaaaaaaaaaaccttataatgagaagtattacaacaatactgctcgcctgtttacaaaaactcagattcgtaaaaaactttcgtaccccacctaataaactcttgtaggatattcttccttttacccgcctgttggtataatctataagacttccccaaatctcgctttttacaaactgtccgatccttaatagttacatgtaacacttttggcatcattaatccgctaa

SEQ ID NO: 72295 - DNA, 1316 bp, Homo sapiens
actattgggacgctgcggcctggccttcaggccactggctaccgaaccccggggctcttcaccagtccagctcgtttccagcaccatgtcggtgcggacgctaccgctgctcttcttgaacttgggcggggagatgctttacatcctcgaccaacggctgcgggcccagaacatcccgggagacaaggcccgcaaagttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaaatatatggtggtctctctgcaggggagttccagctgatccggcagacactcctcatcttcttccaagacctgcacatccgagtatccatgtttctaaaggacaaagttcagaataataacggtcgctttgtgttgccggtgtccgggcctgttccttggggaactgaagttccaggactcatcagaatgttcaacaacaaaggtgaagaagtgaagaggatagaattcaagcatggtggaaactatgtccctgcacccaaagaaggttcttttgaactttatggagaccgagtcctgaaactgggaactaacatgtaagcaaattcttctctgagtgaattcaagtccaagggaggtcacttcatttaaaaaaaaaaaaagagaaacagccagacttctgctatgaaaatccctgccgacaataggagtaatttccccttaggtacactgcatacagaggcctgacatttcaaagggcacccaggaacgccaaacataaggcaactcaacagaatgaaaagatacatgatgttcaatagccatgcaagagaactagccaaaatctgtgttgcagtggaaatccagaaagacttatccgttctgtaaagctgcatatattttcagtgatgcgtgttactcttcacaagaggaggcattgccacccagcctccccaggtgtttttctttaggaagaagtgaaatgtgaatggttaacacacactcagttgcattctgtacccacagcacctttctggatgctatttaatgtctcagaataaaagctacaaactatgct

SEQ ID NO: 72296 - DNA, 1049 bp, Homo sapiens
actattgggacgctgcggcctggccttcaggccactggctaccgaaccccggggctcttcaccagtccagctcgtttccagcaccatgtcggtgcggacgctaccgctgctcttcttgaacttgggcggggagatgctttacatcctcgaccaacggctgcgggcccagaacatcccgggagacaaggcccgcaaagttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaaatatatggtggtctctctgcaggggagttccagctgatccggcagacactcctcatcttcttccaagacctgcacatccgagtatccatgtttctaaaggacaaagttcagaataataacggtcgctttgtgttgccggtgtccgggcctgttccttggggaactgaagttccaggactcatcagaatgttcaacaacaaaggtgaagaagtgaagaggatagaattcaagcatggtggaaactatgtccctgcacccaaagaaggttcttttgaactttatggagaccgagtcctgaaactgggaactaacatgtaagcaaattcttctctgagtgaattcaagtccaagggaggtcacttcatttaaaaaaaaaaaaagagaaacagccagacttctgctatgaaaatccctgccgacaataggagtaatttccccttaggtacactgcatacagaggcctgacatttcaaagggcactgtttggactctgcgcactgtttggactctgggcactgtttggactctg

SEQ ID NO: 72297 - DNA, 1266 bp, Homo sapiens
acccggcaggatgcactgtgacatcggtctcctctgcatcaccgtgagtcaccaaacagcaccctagattgggtgcatgggaggcacgtgtggtatgcacctttcccttctgcattctagctgagccgcttccctgggcgggagcagactttgcaggatgcagcaggaggccaagtctcactggaatccatgtaaaatgtctccagccagggctgcccttactgcttcagaaaggcgcagcagccctctgccataggctccttcccaggactgagtaactggcaggttcagacccattcaatcctatggaaggaatatccagaatggcagagggctggagagaaactaagttgagctggacattgcctgagattgggccaactacaggaacctctccatcccctcacacctgggacggaccaaggtgaacatcattctagaatgtaatggaagctgccctttggcttttccaaaggcaaagggtttagatacagaatgtaaatcaccaagggctgggcatggtggctcatgcctgtaatccccagcactttgggaggccgaggcgggcagatcagttgaggtcaggagttcgagaccagcctgaccaacatagagaaaccctgtctctactaaaaatacaaaattagccaggcctggtagcgcatgcctgtaatcccagctactcaggaggctgaggcaggagaatcgcttgaacccaggaggtagaggttgcagtgagccaagatcatgccattgcactccagcctgggcaacaagagcgaaactctgtctcaattaaaaaaaaaaaaaagaatataaatcaccaaataaatgttaattgctccctacccattaaagttacacttccttacctataaagacaccctccccctccacatactcacgaaaagtctgttggggaggagaagcatattgtgctataaaacacctgttgcatcagatgtacaaagtgcctttcgttttagtctcttttcagcaatctggccaccattcaggggggcctgactgggtgacagatgaatgggaaggttctgacctgttttgagtccggctcccaccttgctgtcacatatcagaatgtcactgctctgagtgtgtcccagggccttggaggtgggccgtgaggtgccgagaagcagccgcagcctcctccctccacctatcccagagcgatgctggtgatttcaaacgtatctgtcctatcagtaaataaacaagatgcagatctctggtatgacagctcca

SEQ ID NO: 72298 - DNA, 385 bp, Homo sapiens
ctcttcatgcccttttacctctcatttccctcataggaccagcaacggagcgaggagctggctcgaatcatgggggagtttgagatcacggagcagccaaggctgagcaccagcaaaggggacgatttgctcgccatgatggatgagttatagctgttctgaccaggcgtcctctgcccccagggagaggctgctggatggtgacccctggggaatgccccatggcccagaatgatgctgctagttttctactgagtgaagccattacgtctatttcttatttatgttgtaaggaactgtgtgagtctcccttgaggagcactcactcttgaaggcacacacatacacatattttcagtgaaatatattctgacttttaaacttg

SEQ ID NO: 72299 - DNA, 1458 bp, Homo sapiens
actattgggacgctgcggcctggccttcaggccactggctaccgaaccccggggctcttcaccagtccagctcgtttccagcaccatgtcggtgcggacgctaccgctgctcttcttgaacttgggcggggagatgctttacatcctcgaccaacggctgcgggcccagaacatcccgggagacaaggcccgcaaagttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaaatatatggtggtctctctgcaggggagttccagctgatccggcagacactcctcatcttcttccaagacctgcacatccgagtatccatgtttctaaaggacaaagttcagaataataacggtcgctttgtgttgccggtgtccgggcctgttccttggggaactgaagttccaggactcatcagaatgttcaacaacaaaggtgaagaagtgaagaggatagaattcaagcatggtggaaactatgtccctgcacccaaagaaggttcttttgaactttatggagaccgagtcctgaaactgggaactaacatgtacagcgtgaatcagcctgtggaaactcatgtgtctggatcatcaaagaacttagcctcatggacccaggaaagcattgctccaaaccctcttgctaaagaagagctgaatttcttggccaggctgatgggagggatggagattaagaaacccagtggccctgagcccggattccggttgaatctctttaccaccgatgaagaagaggaacaagcagcgctaaccaggccagaagagttatcctatgaagttatcaacatacaagccacccaggaccagcaacggagcgaggagctggctcgaatcatgggggagtttgagatcacggagcagccaaggctgagcaccagcaaaggggacgatttgctcgccatgatggatgagttatagctgttctgaccaggcgtcctctgcccccagggagaggctgctggatggtgacccctggggaatgccccatggcccagaatgatgctgctagttttctactgagtgaagccattacgtctatttcttatttatgttgtaaggaactgtgtgagtctcccttgaggagcactcactcttgaaggcacacacatacacatattttcagtgaaatatattctgacttttaaacttga

SEQ ID NO: 72300 - DNA, 1611 bp, Homo sapiens
ttattgctctcagcacctctgcaacattgggaaattagagagtatttttttacagatgagaaaactcaggcccaaagaggttaagaaacttggccaaggttatacaataagttaggaggaaaggagtacttaaatttgcattttctttctccagatccagtgctcactttgggactccgctgctgccaatattatttcagacgtttcccattaacaatacacatcaggtgaccagaaatcctggtttgcccaggaatgtgctggcttactcctgttttcctggcttaattattaaaagcacccgccttgactctcagaagtgtcttggtttgggtgataagtgatatggtcccccgagctgtatggcaagcccagagttggttttcagtaaatgcttgactgaatcactgtttggagattctcacacctgattttgatatgatcccatttcttttgcttgtgtgtgggttggcagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaaatatatggtggtctctctgcaggggagttccagctgatccggcagacactcctcatcttcttccaagacctgcacatccgagtatccatgtttctaaaggacaaagttcagaataataacggtcgctttgtgttgccggtgtccgggcctgttccttggggaactgaagttccaggactcatcagaatgttcaacaacaaaggtgaagaagtgaagaggatagaattcaagcatggtggaaactatgtccctgcacccaaagaaggttcttttgaactttatggagaccgagtcctgaaactgggaactaacatgtacagcgtgaatcagcctgtggaaactcatgtgtctggatcatcaaagaacttagcctcatggacccaggaaagcattgctccaaaccctcttgctaaagaagagctgaatttcttggccaggctgatgggagggatggagattaagaaacccagtggccctgagcccggattccggttgaatctctttaccaccgatgaagaagaggaacaagcagcgctaaccaggccagaagagttatcctatgaagttatcaacatacaagccacccaggaccagcaacggagcgaggagctggctcgaatcatgggggagtttgagatcacggagcagccaaggctgagcaccagcaaaggggacgatttgctcgccatgatggatgagttatagctgttctgaccaggcgtcctctgcccccagggagaggctgctggatggtgacccctggggaatgccccatggcccagaatgatgctgctagttttctactgagtgaagccattacgtctatttcttatttatgttgtaaggaactgtgtgagtctcccttgaggagcactcactcttgaaggcacacacatacacatattttcagtgaaatatattctgacttttaaacttgaaaaaaaaaataaataaaacataaaaaaggg

SEQ ID NO: 72301 - DNA, 1189 bp, Homo sapiens
actattgggacgctgcggcctggccttcaggccactggctaccgaaccccggggctcttcaccagtccagctcgtttccagcaccatgtcggtgcggacgctaccgctgctcttcttgaacttgggcggggagatgctttacatcctcgaccaacggctgcgggcccagaacatcccgggagacaaggcccgcaaagttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaaatatatggtggtctctctgcaggggagttccagctgatccggcagacactcctcatcttcttccaagacctgcacatccgagtatccatgtttctaaaggacaaagttcagaataataacggtcgctttgtgttgccggtgtccgggcctgttccttggggaactgaagttccaggactcatcagaatgttcaacaacaaaggtgaagaagtgaagaggatagaattcaagcatggtggaaactatgtccctgcacccaaagaaggttcttttgaactttatggagaccgagtcctgaaactgggaactaacatgtacagcgtgaatcagcctgtggaaactcatgtgtctggatcatcaaagaacttagcctcatggacccaggaaagcattgctccaaaccctcttgctaaagaagagctgaatttcttggccaggctgatgggagggatggagattaagaaacccagtggccctgagcccggattccggttgaatctctttaccaccgatgaagaagaggagtatgttttaaacctgtttcgttaaagacatataaaaatcccaagcatgacaagaacacaaaatgactattacaaaccagtggcacttataaatatttgtgtaaatatcacaaataaaataccaacaaatttaataatctaaata

SEQ ID NO: 72302 - DNA, 1064 bp, Homo sapiens
actattgggacgctgcggcctggccttcaggccactggctaccgaaccccggggctcttcaccagtccagctcgtttccagcaccatgtcggtgcggacgctaccgctgctcttcttgaacttgggcggggagatgctttacatcctcgaccaacggctgcgggcccagaacatcccgggagacaaggcccgcaaagttctgaatgacatcatctccaccatgttcaatagaaagtttatggaggaattattcaagcctcaagagctctactccaagaaggccctgaggactgtctatgagcgcctggctcatgcctccattatgaaactgaaccaggccagcatggataagctctatgacctgatgaccatggctttcaaatatcaagtattgctgtgtccccgacccaaggatgtgctgctggtcactttcaatcacttggataccatcaagggattcatccgagactccccaaccatcctgcagcaagtggacgagactttgcggcagctgacagaaatatatggtggtctctctgcaggggagttccagctgatccggcagacactcctcatcttcttccaagacctgcacatccgagtatccatgtttctaaaggacaaagttcagaataataacggtcgctttgtgttgccggtgtccgggcctgttccttggggaactgaagttccaggactcatcagaatgttcaacaacaaaggtgaagaagtgaagaggatagaattcaagcatggtggaaactatgtccctgcacccaaagaaggttcttttgaactttatggagaccgagtcctgaaactgggaactaacatgtacagcgtgaatcagcctgtggaaactcatgtgtctggatcatcaaagaacttagcctcatggacccaggtgagcttctgccttccttgcctaccctcacagcttctctctagatacggaagtctacataaagagaggtgagaacgctttagatttcggatctagccaacatttcccctgttgtgtgcaatcttctccattccaccttacgagtacaacgtgccggtgg

SEQ ID NO: 72303 - DNA, 744 bp, Homo sapiens
ggggaccacttctctgggacacattgccttctgttttctccagcatgcgcttgctccagctcctgttcagggccagccctgccaccctgctcctggttctctgcctgcagttgggggccaacaaagctcaggacaacactcggaagatcataataaagaattttgacattcccaagtcagtacgtccaaatgacgaagtcactgcagtgcttgcagttcaaacagaattgaaagaatgcatggtggttaaaacttacctcattagcagcatccctctacaaggtgcatttaactataagtatactgcctgcctatgtgacgacaatccaaaaaccttctactgggacttttacaccaacagaactgtgcaaattgcagccgtcgttgatgttattcgggaattaggcatctgccctgatgatgctgctgtaatccccatcaaaaacaaccggttttatactattgaaatcctaaaggtagaataatggaagccctgtctgtttgccacacccaggtgatttcctctaaagaaacttggctggaatttctgctgtggtctataaaataaacttcttaacatgcttaagcttaagtgaacagcgaccccacacatctctttttccgacgcccctgcccccctagaaagtttttagacacaccttgggccgggtccccaaaggttgtcaacttggctcattttccaacacctcccgaccacgcccggggcattcccctctaaaaccg

SEQ ID NO: 72304 - DNA, 577 bp, Homo sapiens
ccgggctgcaggaattcggcacgaggttttctccagcatgcgcttgctccagctcctgttcagggccagccctgccaccctgctcctggttctctgcctgcagttgggggccaacaaagctcaggacaacactcggaagatcataataaagaattttgacattcccaagtcagtacgtccaaatgacgaagtcactgcagtgcttgcagttcaaacagaattgaaagaatgcatggtggttaaaacttacctcattagcagcatccctctacaaggtgcatttaactataagtatactgcctgcctatgtgacgacaatccaaaaaccttctactgggacttttacaccaacagaactgtgcaaattgcagccgtcgttgatgttattcgggaattaggcatctgccctgatgatgctgctgtaatccccatcaaaaacaaccggttttatactattgaaatcctaaaggtagaataatggaagccctgtctgtttgccacacccaggtgatttcctctaaagaaacttggctggaatttctgctgtggtctataaaataaacttcttaacatgctt

SEQ ID NO: 72305 - DNA, 507 bp, Homo sapiens
gacctcaagcttttctcttaagactttcaactgatccaatgagtctgacccatattatggagtcggaagatcataataaagaattttgacattcccaagtcagtacgtccaaatgacgaagtcactgcagtgcttgcagttcaaacagaattgaaagaatgcatggtggttaaaacttacctcattagcagcatccctctacaaggtgcatttaactataagtatactgcctgcctatgtgacgacaatccaaaaaccttctactgggacttttacaccaacagaactgtgcaaattgcagccgtcgttgatgttattcgggaattaggcatctgccctgatgatgctgctgtaatccccatcaaaaacaaccggttttatactattgaaatcctaaaggtagaataatggaagccctgtctgtttgccacacccaggtgatttcctctaaagaaacttggctggaatttctgctgtggtctataaaataaacttcttaacatgctt

SEQ ID NO: 72306 - DNA, 595 bp, Homo sapiens
tccaggggattccaatgctgaacaattgatccaagccccataatttccctcccttgcccatcctgtgccccttgccctgttcatggctcccccctcactcaaagattggtctctgatcctggtgttctgattctctcttcccacaatcagtcggaagatcataataaagaattttgacattcccaagtcagtacgtccaaatgacgaagtcactgcagtgcttgcagttcaaacagaattgaaagaatgcatggtggttaaaacttacctcattagcagcatccctctacaaggtgcatttaactataagtatactgcctgcctatgtgacgacaatccaaaaaccttctactgggacttttacaccaacagaactgtgcaaattgcagccgtcgttgatgttattcgggaattaggcatctgccctgatgatgctgctgtaatccccatcaaaaacaaccggttttatactattgaaatcctaaaggtagaataatggaagccctgtctgtttgccacacccaggtgatttcctctaaagaaacttggctggaatttctgctgtggtctataaaataaacttcttaacatgctt

SEQ ID NO: 72307 - DNA, 584 bp, Homo sapiens
ggggaccacttctctgggacacattgccttctgttttctccagcatgcgcttgctccagctcctgttcagggccagccctgccaccctgctcctggttctctgcctgcagttgggggccaacaaagctcaggacaacactcggaagatcataataaagaattttgacattcccaagtcagtacgtccaaatgacgaagtcactgcagtgcttgcagttcaaacagaattgaaagaatgcatggtggttaaaacttacctcattagcagcatccctctacaaggtgcatttaactataagtatactgcctgcctatgtgacgacaatccaaaaaccttctactgggacttttacaccaacagaactgtgcaaattgcagccgtcgttgatgttattcgggaattaggcatctgccctgatgatgctgctgtaatccccatcaaaaacaaccggttttatactattgaaatcctaaaggtagaataatggaagccctgtctgtttgccacacccaggtgatttcctctaaagaaacttggctggaatttctgctgtggtctataaaataaacttcttaacatgctt

SEQ ID NO: 72308 - DNA, 737 bp, Homo sapiens
ccgggctgcaggaattcggcacgaggttttctccagcatgcgcttgctccagctcctgttcagggccagccctgccaccctgctcctggttctctgcctgcagttgggggccaacaaagctcaggacaacactcggaagatcataataaagaattttgacattcccaagtcagtacgtccaaatgacgaagtcactgcagtgcttgcagttcaaacagaattgaaagaatgcatggtggttaaaacttacctcattagcagcatccctctacaaggtgcatttaactataagtatactgcctgcctatgtgacgacaatccaaaaaccttctactgggacttttacaccaacagaactgtgcaaattgcagccgtcgttgatgttattcgggaattaggcatctgccctgatgatgctgctgtaatccccatcaaaaacaaccggttttatactattgaaatcctaaaggtagaataatggaagccctgtctgtttgccacacccaggtgatttcctctaaagaaacttggctggaatttctgctgtggtctataaaataaacttcttaacatgcttaagcttaagtgaacagcgaccccacacatctctttttccgacgcccctgcccccctagaaagtttttagacacaccttgggccgggtccccaaaggttgtcaacttggctcattttccaacacctcccgaccacgcccggggcattcccctctaaaaccg

SEQ ID NO: 72309 - DNA, 1677 bp, Homo sapiens
catggcattcctaaagttctctttgtttgctaatacaccacattatcctcaatgctacctctgaaatcacactatcaaatagcccctactatgtaattctgtaactttttttcctgaatgtttaggtctattttggcatgcagggattaagaaaatagctatctgagcatatattttatagttcactaatgaaccctactttgaccctgtgggttaatgaatgaaaagtatctgctattatggtgtggtttcatcttatcaattacatatttttgttttgaaatttgtcacctttgtcttcaccattcttttctcttggacagactgttagccccttaactcatgtacttgccttgacttaagttaccagtctgtccaagagaaaagaattacattcatggcaaatgcccccagtcaggcacaacataccatatacataatattcttgatgagcttaaagtagccacacagcactcagggcagcctccactaactgattggaaataagcctatttgccatatctccctgaaactttctattaacaaagccacaaaacgcttaaacaaagaaaaattagataatatcaatagcccatcttctaacacattgcctagctcattactttcaatacatattttccaaactaaaaattaaaatctcaactctttaagagaagtttcgtaattttgtagtataagagattatcctggcaatatagttttaatgccaatatattgaaacttacatgacatttcagtggttttgcagtgttttcccaagtatggtacctttaccactgaaggtacacagtgatttctgggtgttaaacagatgaacattttttattttaatagctatacaatataaccagcaaataaaatccatgttttcatggatattattgcttagagttagttaagttttaaaatgtgatttaaaggaaaatattaagtactagtacaagagatacccagtatgacagaaatgatagtagaaggcaaaagacaagtttaagaaatgctggtttgtgtcagcagtgggcagaaaattggggactcggggctgccatgagaatgataggtgtttgatcaccacagctataggagttctttgaaagtagatctggacattttgaaatagtcaaggggaggtgtcctcagggatgtcataactgttgacctcaagaccaatgcatcagttagaaaaacattttaaggatgctcagcactgctatgtatcacagggtccctccataggacatacatacttgatctgctagcgtttttgtcatacgttagaatgaatgaatatgtgttggaatgtcttgacacagttaacctgaacacatacagctggaatccccctgttgcagttgttattatatgtaatataatagcaattgcagacagcttggattctttctcacagatattccttttgttcaattagaaattctacataattctggccgagcacagtggatcacttgaggtcaggaattcaagaccagcctggccaacatggtgaaaccccgtctttacttaaaatacaaaaattagccaggcgtggtggcgggcacctgtaatcccagctactcgggaggcagaggttgcagtgatccaagatcacgccattgcactctagcctgggcgacaagaaagaaattccatctcaaa

SEQ ID NO: 72310 - DNA, 1590 bp, Homo sapiens
catggcattcctaaagttctctttgtttgctaatacaccacattatcctcaatgctacctctgaaatcacactatcaaatagcccctactatgtaattctgtaactttttttcctgaatgtttaggtctattttggcatgcagggattaagaaaatagctatctgagcatatattttatagttcactaatgaaccctactttgaccctgtgggttaatgaatgaaaagtatctgctattatggtgtggtttcatcttatcaattacatatttttgttttgaaatttgtcacctttgtcttcaccattcttttctcttggacagactgttagccccttaactcatgtacttgccttgacttaagttaccagtctgtccaagagaaaagaattacattcatggcaaatgcccccagtcaggcacaacataccatatacataatattcttgatgagcttaaagtagccacacagcactcagggcagcctccactaactgattggaaataagcctatttgccatatctccctgaaactttctattaacaaagccacaaaacgcttaaacaaagaaaaattagataatatcaatagcccatcttctaacacattgcctagctcattactttcaatacatattttccaaactaaaaattaaaatctcaactctttaagagaagtttcgtaattttgtagtataagagattatcctggcaatatagttttaatgccaatatattgaaacttacatgacatttcagtggttttgcagtgttttcccaagtatggtacctttaccactgaaggtacacagtgatttctgggtgttaaacagatgaacattttttattttaatagctatacaatataaccagcaaataaaatccatgttttcatggatattattgcttagagttagttaagttttaaaatgtgatttaaaggaaaatattaagtactagtacaagagatacccagtatgacagaaatgatagtagaaggcaaaagacaagtttaagaaatgctggtttgtgtcagcagtgggcagaaaattggggactcggggctgccatgagaatgataggtgtttgatcaccacagctataggagttctttgaaagtagatctggacattttgaaatagtcaaggggaggtgtcctcagggatgtcataactgttgacctcaagaccaatgcatcagttagaaaaacattttaaggatgctcagcactgctatgtatcacagggtccctccataggacatacatacttgatctgctagcgtttttgtcatacgttagaatgaatgaatatgtgttggaatgtcttgacacagttaacctgaacacatacagctggaatccccctgttgcagttgttattatatgtaatataatagcaattgcagacagcttggattctttctcacagatattccttttgttcaattagaaattctacataattctggccgagcacagtggatcacttgaggtcaggaattcaagaccagcctggccaacatggtgaaaccccgtcaagggtacatgcaagcccggtacatgcaagaccggtaccccgttacatgcaag

SEQ ID NO: 72311 - DNA, 1667 bp, Homo sapiens
ggcacgaggatacctcctcatcaactctgacatagtgtgcgaacaggacatctacgagtggactaagatcaatggccggcggcgggtgccgcgcggggggcgggcggcgcggagtaggtggcggcggccatggccgaggcgtcgccgcatcccggacggtacttctgccactgctgctccgtggagatcgtcccgcgcctgccggattatatctgtccaagatgcgagtctggttttatcgaggagcttccggaagagaccaggagcacagaaaatggttctgccccctccacagctcccacagaccagagccggccaccgttggagcacgtggaccagcacctgttcacgctgccgcagggctacggacagtttgctttcggcatcttcgatgacagcttcgagatccccacgttccctcctggggcgcaggctgacgacggcagggaccctgagagccggcgggagagagaccatccgtcccggcaccggtacggcgcccgacagccccgcgcccgcctcaccacgcggcgggccaccggccggcacgaaggcgtccccacgctggaagggatcatccagcagctcgtcaacggcatcatcacgcccgccaccatccccagcctgggcccctggggagtcctgcactcaaaccctatggactacgcctggggggccaacggcctggatgccatcatcacacagctcctcaatcagtttgaaaacacaggccccccaccggcagataaagagaaaatccaggccctccccaccgtccccgtcactgaggagcacgtaggctccgggctcgagtgccctgtgtgcaaggacgactacgcgctgggtgagcgtgtgcggcagctgccctgcaaccacctgttccacgacggctgcatcgtgccctggctggagcagcacgacagctgccccgtctgccgaaaaagcctcacgggacagaacacggccacgaacccccctggcctcactggggtgagcttctcctcctcgtcgtcatcgtcctcctccagctcgcccagcaacgagaacgccacaagcaactcgtgagcccacgtcggccgtcgggaaagcacggggcctttcccacccaccctcagccagcgccacacggcacccacagactgggtgccccggcggcgccacgcttggctggtcagcgctgcaggtcccgcctgttccagggcaggacccgggcccggcccaccggccccctggcttgggaaggcgtgggccacatggtcccctctggggcgtccccagcctccccgtcctctgtctaacctcaccctctaaacgttcagcggtggaaagatttttataattttaaattattactgctttgaaataaacggacgtttgagctcacgtggcggccatgcatggtttgtggcggaagacggggcccagcggctcccccagcgctgaagcacggggttcagcggctcccccagtgctgcaggtgccgccaggacgggccacgtgggcccccagcctccccctcggccgcctccacgacccggagtaggggggctcgggaccatgaggatgaccagcaaaattcaagaacaaaactgctccaacagacttttttaaaggaaaaaatatgtgtatcttgaaagctatttaaaatacactacttacaaagagaa

SEQ ID NO: 72312 - DNA, 2096 bp, Homo sapiens
  misc_feature (696)..(696): n is a, c, g, or t
aaaaaaaaaagtagccgagagtggtggacctcttctgtggtcccagctacttgggaggctgaggcgggaggatcgcttaagcccagcaggttggggctgcagtgaaccaagatcaagctgcttctctcctgcctcggcattagagtgagaccctggctcatagtaaaataaataaatagaagctaatctagaagctgatgctggccctgcccttggtgctcaccacggacctggcaggcctggcgcctctcctgtgcgtggggcggcctcaccccgtgactggcgctctcttttccaggatcatccagcagctcgtcaacggcatcatcacgcccgccaccatccccagcctgggcccctggggagtcctgcactcaaaccctatggactacgcctggggggccaacggcctggatgccatcatcacacaggtacagcgtggccacggcccagagtgcctgctgggggagggctgggctgcccacccctgggagctgccccactgcctggacccacgaagccccacaaaggtcaaaggggatgcgggcacagcctccacgctctggcgggcacagggggcagctccggccttcctcctgccatttctgagtcttggcaactttgggggttctcctgtgttcacgcggaacgttgtagcaaaaccgcggggaggactcgcccacagtcacatggtcnggaggccacgcggtccctcttcccgagaggtcgcgccctgacctgcttccaagtgccacccgtctcagccttgctgaggagcccttggagcattttgtcactggcaggacccgaccctcacagtagcccaccagccggagcacggcccccccattccgccgtcagggcactcaggagcgcggcccccccccccattccgctgtcagggacccaggagcgcgggcctccgcccattcccccattccaccgtcaggggacccaggagcgggggggccgcgtgggctccacagtgatctccgaccccgggcgggctccaaggggcccagggcccaggacaaacgcggcctcggtgcttttgcaggtcctgcagcctcgcgtttcagagccccgggccgggcccccgaggagctcccggcactctcgcctcttgtctttcagctcctcaatcagtttgaaaacacaggccccccaccggcagataaagagaaaatccaggccctccccaccgtccccgtcactgaggagcacgtaggctccgggctcgagtgccctgtgtgcaaggacgactacgcgctgggtgagcgtgtgcggcagctgccctgcaaccacctgttccacgacggctgcatcgtgccctggctggagcagcacgacagctgccccgtctgccgaaaaagcctcacgggacagaacacggccacgaacccccctggcctcactggggtgagcttctcctcctcgtcgtcatcgtcctcctccagctcgcccagcaacgagaacgccacaagcaactcgtgagcccacgtcggccgtcgggaaagcacggggcctttcccacccaccctcagccagcgccacacggcacccacagactgggtgccccggcggcgccacgcttggctggtcagcgctgcaggtcccgcctgttccagggcaggacccgggcccggcccaccggccccctggcttgggaaggcgtgggccacatggtcccctctggggcgtccccagcctccccgtcctctgtctaacctcaccctctaaacgttcagcggtggaaagatttttataattttaaattattactgctttgaaataaacggacgtttgagctcacgtggcggccatgcatggtttgtggcggaagacggggcccagcggctcccccagcgctgaagcacggggttcagcggctcccccagtgctgcaggtgccgccaggacgggccacgtgggcccccagcctccccctcggccgcctccacgacccggagtaggggggctcgggaccatgaggatgaccagcaaaattcaagaacaaaactgctccaacagacttttttaaaggaaaaaatatgtgtatcttgaaagctatttaaaatacactacttacaaagagaa

SEQ ID NO: 72313 - DNA, 548 bp, Homo sapiens
aaagccagggctggtaaccggctcctgggaaagttccccggggaatattggtcgaacccccactggccgtatcagcaacgcacgacagctgccccgtctgccgaaaaagcctcacgggacagaacacggccacgaacccccctggcctcactggggtgagcttctcctcctcgtcgtcatcgtcctcctccagctcgcccagcaacgagaacgccacaagcaactcgtgagcccacgtcggccgtcgggaaagcacggggcctttcccacccaccctcagccagcgccacacggcacccacagactgggtgccccggcggcgccacgcttggctggtcagcgctgcaggtcccgcctgttccagggcaggacccgggcccggcccaccggccccctggcttgggaaggcgtgggccacatggtcccctctggggcgtccccagcctccccgtcctctgtctaacctcaccctctaaacgttcagcggtggaaagatttttataattttaaattattactgctttgaaataaacggacgtttgagctca

SEQ ID NO: 72314 - DNA, 1433 bp, Homo sapiens
gtgcgtgagcgtgcgcgggcgcgtcggccggcgagggagcagcaaacggccggcggcgggtgccgcgcggggggcgggcggcgcggagtaggtggcggcggccatggccgaggcgtcgccgcatcccggacggtacttctgccactgctgctccgtggagatcgtcccgcgcctgccggattatatctgtccaagatgcgagtctggttttatcgaggagcttccggaagagaccaggagcacagaaaatggttctgccccctccacagctcccacagaccagagccggccaccgttggagcacgtggaccagcacctgttcacgctgccgcagggctacggacagtttgctttcggcatcttcgatgacagcttcgagatccccacgttccctcctggggcgcaggctgacgacggcagggaccctgagagccggcgggagagagaccatccgtcccggcaccggtacggcgcccgacagccccgcgcccgcctcaccacgcggcgggccaccggccggcacgaaggcgtccccacgctggaagggatcatccagcagctcgtcaacggcatcatcacgcccgccaccatccccagcctgggcccctggggagtcctgcactcaaaccctatggactacgcctggggggccaacggcctggatgccatcatcacacagctcctcaatcagtttgaaaacacaggccccccaccggcagataaagagaaaatccaggccctccccaccgtccccgtcactgaggagcacgtaggctccgggctcgagtgccctgtgtgcaaggacgactacgcgctgggtgagcgtgtgcggcagctgccctgcaaccacctgttccacgacggctgcatcgtgccctggctggagcagcacgacagctgccccgtctgccgaaaaagcctcacgggacagaacacggccacgaacccccctggcctcactggggtgagcttctcctcctcgtcgtcatcgtcctcctccagctcgcccagcaacgagaacgccacaagcaactcgtgagcccacgtcggccgtcgggaaagcacggggcctttcccacccaccctcagccagcgccacacggcacccacagactgggtgccccggcggcgccacgcttggctggtcagcgctgcaggtcccgcctgttccagggcaggacccgggcccggcccaccggccccctggcttgggaaggcgtgggccacatggccagtgctgcaggtgccgccaggacgggccacgtgggcccccagcctccccctcggccgcctccacgacccggagtaggggggctcgggaccatgaggatgaccagcaaaattcaagaacaaaactgctccaacagacttttttaaaggaaaaaatatgtgtatcttgaaagctatttaaaatacactacttacaaagagaa

SEQ ID NO: 72315 - DNA, 1701 bp, Homo sapiens
gtgcgtgagcgtgcgcgggcgcgtcggccggcgagggagcagcaaacggccggcggcgggtgccgcgcggggggcgggcggcgcggagtaggtggcggcggccatggccgaggcgtcgccgcatcccggacggtacttctgccactgctgctccgtggagatcgtcccgcgcctgccggattatatctgtccaagatgcgagtctggttttatcgaggagcttccggaagagaccaggagcacagaaaatggttctgccccctccacagctcccacagaccagagccggccaccgttggagcgcccccagcagactgcacgggcctgagcccccgaggtcacgcccccctcctctccccagcacgtggaccagcacctgttcacgctgccgcagggctacggacagtttgctttcggcatcttcgatgacagcttcgagatccccacgttccctcctggggcgcaggctgacgacggcagggaccctgagagccggcgggagagagaccatccgtcccggcaccggtacggcgcccgacagccccgcgcccgcctcaccacgcggcgggccaccggccggcacgaaggcgtccccacgctggaagggatcatccagcagctcgtcaacggcatcatcacgcccgccaccatccccagcctgggcccctggggagtcctgcactcaaaccctatggactacgcctggggggccaacggcctggatgccatcatcacacagctcctcaatcagtttgaaaacacaggccccccaccggcagataaagagaaaatccaggccctccccaccgtccccgtcactgaggagcacgtaggctccgggctcgagtgccctgtgtgcaaggacgactacgcgctgggtgagcgtgtgcggcagctgccctgcaaccacctgttccacgacggctgcatcgtgccctggctggagcagcacgacagctgccccgtctgccgaaaaagcctcacgggacagaacacggccacgaacccccctggcctcactggggtgagcttctcctcctcgtcgtcatcgtcctcctccagctcgcccagcaacgagaacgccacaagcaactcgtgagcccacgtcggccgtcgggaaagcacggggcctttcccacccaccctcagccagcgccacacggcacccacagactgggtgccccggcggcgccacgcttggctggtcagcgctgcaggtcccgcctgttccagggcaggacccgggcccggcccaccggccccctggcttgggaaggcgtgggccacatggtcccctctggggcgtccccagcctccccgtcctctgtctaacctcaccctctaaacgttcagcggtggaaagatttttataattttaaattattactgctttgaaataaacggacgtttgagctcacgtggcggccatgcatggtttgtggcggaagacggggcccagcggctcccccagcgctgaagcacggggttcagcggctcccccagtgctgcaggtgccgccaggacgggccacgtgggcccccagcctccccctcggccgcctccacgacccggagtaggggggctcgggaccatgaggatgaccagcaaaattcaagaacaaaactgctccaacagacttttttaaaggaaaaaatatgtgtatcttgaaagctatttaaaatacactacttacaaagagaa

SEQ ID NO: 72316 - DNA, 1560 bp, Homo sapiens
gtgcgtgagcgtgcgcgggcgcgtcggccggcgagggagcagcaaacggccggcggcgggtgccgcgcggggggcgggcggcgcggagtaggtggcggcggccatggccgaggcgtcgccgcatcccggacggtacttctgccactgctgctccgtggagatcgtcccgcgcctgccggattatatctgtccaagatgcgagtctggttttatcgaggagcttccggaagagaccaggagcacagaaaatggttctgccccctccacagctcccacagaccagagccggccaccgttggagcacgtggaccagcacctgttcacgctgccgcagggctacggacagtttgctttcggcatcttcgatgacagcttcgagatccccacgttccctcctggggcgcaggctgacgacggcagggaccctgagagccggcgggagagagaccatccgtcccggcaccggatcatccagcagctcgtcaacggcatcatcacgcccgccaccatccccagcctgggcccctggggagtcctgcactcaaaccctatggactacgcctggggggccaacggcctggatgccatcatcacacagctcctcaatcagtttgaaaacacaggccccccaccggcagataaagagaaaatccaggccctccccaccgtccccgtcactgaggagcacgtaggctccgggctcgagtgccctgtgtgcaaggacgactacgcgctgggtgagcgtgtgcggcagctgccctgcaaccacctgttccacgacggctgcatcgtgccctggctggagcagcacgacagctgccccgtctgccgaaaaagcctcacgggacagaacacggccacgaacccccctggcctcactggggtgagcttctcctcctcgtcgtcatcgtcctcctccagctcgcccagcaacgagaacgccacaagcaactcgtgagcccacgtcggccgtcgggaaagcacggggcctttcccacccaccctcagccagcgccacacggcacccacagactgggtgccccggcggcgccacgcttggctggtcagcgctgcaggtcccgcctgttccagggcaggacccgggcccggcccaccggccccctggcttgggaaggcgtgggccacatggtcccctctggggcgtccccagcctccccgtcctctgtctaacctcaccctctaaacgttcagcggtggaaagatttttataattttaaattattactgctttgaaataaacggacgtttgagctcacgtggcggccatgcatggtttgtggcggaagacggggcccagcggctcccccagcgctgaagcacggggttcagcggctcccccagtgctgcaggtgccgccaggacgggccacgtgggcccccagcctccccctcggccgcctccacgacccggagtaggggggctcgggaccatgaggatgaccagcaaaattcaagaacaaaactgctccaacagacttttttaaaggaaaaaatatgtgtatcttgaaagctatttaaaatacactacttacaaagagaa

SEQ ID NO: 72317 - DNA, 1439 bp, Homo sapiens
ctggccgtggcaggagaggctggttgcctgacagcccgccagcctgggattatatctgtccaagatgcgagtctggttttatcgaggagcttccggaagagaccaggagcacagaaaatggttctgccccctccacagctcccacagaccagagccggccaccgttggagcttcgagatccccacgttccctcctggggcgcaggctgacgacggcagggaccctgagagccggcgggagagagaccatccgtcccggcaccggtacggcgcccgacagccccgcgcccgcctcaccacgcggcgggccaccggccggcacgaaggcgtccccacgctggaagggatcatccagcagctcgtcaacggcatcatcacgcccgccaccatccccagcctgggcccctggggagtcctgcactcaaaccctatggactacgcctggggggccaacggcctggatgccatcatcacacagctcctcaatcagtttgaaaacacaggccccccaccggcagataaagagaaaatccaggccctccccaccgtccccgtcactgaggagcacgtaggctccgggctcgagtgccctgtgtgcaaggacgactacgcgctgggtgagcgtgtgcggcagctgccctgcaaccacctgttccacgacggctgcatcgtgccctggctggagcagcacgacagctgccccgtctgccgaaaaagcctcacgggacagaacacggccacgaacccccctggcctcactggggtgagcttctcctcctcgtcgtcatcgtcctcctccagctcgcccagcaacgagaacgccacaagcaactcgtgagcccacgtcggccgtcgggaaagcacggggcctttcccacccaccctcagccagcgccacacggcacccacagactgggtgccccggcggcgccacgcttggctggtcagcgctgcaggtcccgcctgttccagggcaggacccgggcccggcccaccggccccctggcttgggaaggcgtgggccacatggtcccctctggggcgtccccagcctccccgtcctctgtctaacctcaccctctaaacgttcagcggtggaaagatttttataattttaaattattactgctttgaaataaacggacgtttgagctcacgtggcggccatgcatggtttgtggcggaagacggggcccagcggctcccccagcgctgaagcacggggttcagcggctcccccagtgctgcaggtgccgccaggacgggccacgtgggcccccagcctccccctcggccgcctccacgacccggagtaggggggctcgggaccatgaggatgaccagcaaaattcaagaacaaaactgctccaacagacttttttaaaggaaaaaatatgtgtatcttgaaagctatttaaaatacactacttacaaagagaa

SEQ ID NO: 72318 - DNA, 1761 bp, Homo sapiens
  misc_feature (725)..(725): n is a, c, g, or t
  misc_feature (746)..(746): n is a, c, g, or t
  misc_feature (799)..(799): n is a, c, g, or t
  misc_feature (877)..(877): n is a, c, g, or t
gtgcgtgagcgtgcgcgggcgcgtcggccggcgagggagcagcaaacggccggcggcgggtgccgcgcggggggcgggcggcgcggagtaggtggcggcggccatggccgaggcgtcgccgcatcccggacggtacttctgccactgctgctccgtggagatcgtcccgcgcctgccggattatatctgtccaagatgcgagtctggttttatcgaggagcttccggaagagaccaggagcacagaaaatggttctgccccctccacagctcccacagaccagagccggccaccgttggagcacgtggaccagcacctgttcacgctgccgcagggctacggacagtttgctttcggcatcttcgatgacagcttcgagatccccacgttccctcctggggcgcaggctgacgacggcagggaccctgagagccggcgggagagagaccatccgtcccggcaccggtacggcgcccgacagccccgcgcccgcctcaccacgcggcgggccaccggccggcacgaaggcgtccccacgctggaaggtgtatctagtccgagtcagttcagtcgaacaggatcatcatccaggccgcaggcatcgatcaccctagctcatggtgccgcgcatgcgaggagttccatgcaacatctgaatccgcgtatgaggagctcacagccatggatcgggcaccaacagtgacttggcatgaccaatcaatgcnaccacggacgcctcgcatccntagatcgcagattgtgtggaacacacatacccaggcaccgcggccagcgggcnatcattagcagcaggaacaatcacaagggtcgcttcactcgcgaccagtgccccagatgcggtagcaggagcacagtnaggcatcctggggtacgcagttgtcctcgtcgtagcaacaggtacaagagtcacgcgctgggtgagcgtgtgcggcagctgccctgcaaccacctgttccacgacggctgcatcgtgccctggctggagcagcacgacagctgccccgtctgccgaaaaagcctcacgggacagaacacggccacgaacccccctggcctcactggggtgagcttctcctcctcgtcgtcatcgtcctcctccagctcgcccagcaacgagaacgccacaagcaactcgtgagcccacgtcggccgtcgggaaagcacggggcctttcccacccaccctcagccagcgccacacggcacccacagactgggtgccccggcggcgccacgcttggctggtcagcgctgcaggtcccgcctgttccagggcaggacccgggcccggcccaccggccccctggcttgggaaggcgtgggccacatggtcccctctggggcgtccccagcctccccgtcctctgtctaacctcaccctctaaacgttcagcggtggaaagatttttataattttaaattattactgctttgaaataaacggacgtttgagctcacgtggcggccatgcatggtttgtggcggaagacggggcccagcggctcccccagcgctgaagcacggggttcagcggctcccccagtgctgcaggtgccgccaggacgggccacgtgggcccccagcctccccctcggccgcctccacgacccggagtaggggggctcgggaccatgaggatgaccagcaaaattcaagaacaaaactgctccaacagacttttttaaaggaaaaaatatgtgtatcttgaaagctatttaaaatacactacttacaaagagaa

SEQ ID NO: 72319 - DNA, 773 bp, Homo sapiens
gtgcgtgagcgtgcgcgggcgcgtcggccggcgagggagcagcaaacggccggcggcgggtgccgcgcggggggcgggcggcgcggagtaggtggcggcggccatggccgaggcgtcgccgcatcccggacggtacttctgccactgctgctccgtggagatcgtcccgcgcctgccggattatatctgtccaagatgcgagtctggttttatcgaggagcttccggaagagaccaggagcacagaaaatggttctgccccctccacagctcccacagaccagagccggccaccgttggagcacgtggaccagcacctgttcacgctgccgcagggctacggacagtttgctttcggcatcttcgatgacagcttcgagatccccacgttccctcctggggcgcaggctgacgacggcagggaccctgagagccggcgggagagagaccatccgtcccggcaccggtacggcgcccgacagccccgcgcccgcctcaccacgcggcgggccaccggccggcacgaaggcgtccccacgctggaaggggtgagggggccccgggggtggccgcgagggccccacgccttgaggtcggaagttctggcgcttagaatccagcacgggttccacggaaacgtggcatcatccataggctctctggagaggccgcccggccaggccctccagccccctgtgactccccacacggcccttcggagacagaagtatgccggttcagggtgtgtgggttgaccacagagtggggcaccgt

SEQ ID NO: 72320 - DNA, 285 bp, Homo sapiens
cctcaatcagtttgaaaacacaggccccccaccggcagataaagagaaaatccaggccctccccaccgtccccgtcactgaggagcacgtaggtatgagagctcagcctcccgagtagtgggaattacaggcacccgccgccacgcctggctcatacttgtattttcagtagagacagggtttcaccatgttggtcaggcaggtctcgaactcctgacctcaggtgatcctcctgcctcggcctcccaaagtgctgggatgacaggcgtgagccaccgcacccgg

SEQ ID NO: 72321 - DNA, 1357 bp, Homo sapiens
gtgcgtgagcgtgcgcgggcgcgtcggccggcgagggagcagcaaacggccggcggcgggtgccgcgcggggggcgggcggcgcggagtaggtggcggcggccatggccgaggcgtcgccgcatcccggacggtacttctgccactgctgctccgtggagatcgtcccgcgcctgccggattatatctgtccaagatgcgagtctggttttatcgaggagcttccggaagagaccaggagcacagaaaatggttctgccccctccacagctcccacagaccagagccggccaccgttggagcacgtggaccagcacctgttcacgctgccgcagggctacggacagtttgctttcggcatcttcgatgacagcttcgagatccccacgttccctcctggggcgcaggctgacgacggcagggaccctgagagccggcgggagagagaccatccgtcccggcaccggtacggcgcccgacagccccgcgcccgcctcaccacgcggcgggccaccggccggcacgaaggcgtccccacgctggaagggatcatccagcagctcgtcaacggcatcatcacgcccgccaccatccccagcctgggcccctggggagtcctgcactcaaaccctatggactacgcctggggggccaacggcctggatgccatcatcacacagctcctcaatcagtttgaaaacacaggccccccaccggcagataaagagaaaatccaggccctccccaccgtccccgtcactgaggagcacgtaggctccgggctcgagtgccctgtgtgcaaggacgactacgcgctgggtgagcgtgtgcggcagctgccctgcaaccacctgttccacgacggctgcatcgtgccctggctggagcagcacgacagctgccccgtctgccgaaaaagcctcacgggacagaacacggccacgaacccccctggcctcactggggtgagcttctcctcctcgtcgtcatcgtcctcctccagctcgcccagcaacgagaacgccacaagcaactcgtgagcccacgtcggccgtcgggaaagcacggggcctttcccacccaccctcagccagcgccacacggcacccacagactgggtgccccggcggcgccacgcttggctggtcagcgctgcaggtcccgcctgttccagggcaggacccgggcccggcccaccggccccctggcttgggaaggcgtgggccacatggtcccctctggggcgtccccagcctccccgtcctctgtctaacctcaccctctaaacgttcagcggtggaaagatttttataattttaaattattactgctttgaaataaacggacgtttgagctca

SEQ ID NO: 72322 - DNA, 1436 bp, Homo sapiens
gtgcgtgagcgtgcgcgggcgcgtcggccggcgagggagcagcaaacggccggcggcgggtgccgcgcggggggcgggcggcgcggagtaggtggcggcggccatggccgaggcgtcgccgcatcccggacggtacttctgccactgctgctccgtggagatcgtcccgcgcctgccggattatatctgtccaagatgcgagtctggttttatcgaggagcttccggaagagaccaggagcacagaaaatggttctgccccctccacagctcccacagaccagagccggccaccgttggagcacgtggaccagcacctgttcacgctgccgcagggctacggacagtttgctttcggcatcttcgatgacagcttcgagatccccacgttccctcctggggcgcaggctgacgacggcagggaccctgagagccggcgggagagagaccatccgtcccggcaccggtacggcgcccgacagccccgcgcccgcctcaccacgcggcgggccaccggccggcacgaaggcgtccccacgctggaagggatcatccagcagctcgtcaacggcatcatcacgcccgccaccatccccagcctgggcccctggggagtcctgcactcaaaccctatggactacgcctggggggccaacggcctggatgccatcatcacacagctcctcaatcagtttgaaaacacaggccccccaccggcagataaagagaaaatccaggccctccccaccgtccccgtcactgaggagcacgtaggctccgggctcgagtgccctgtgtgcaaggacgactacgcgctgggtgagcgtgtgcggcagctgccctgcaaccacctgttccacgacggctgcatcgtgccctggctggagcagcacgacagctgccccgtctgccgaaaaagcctcacgggacagaacacggccacgaacccccctggcctcactggggtgagcttctcctcctcgtcgtcatcgtcctcctccagctcgcccagcaacgagaacgccactcccctctggggcgtccccagcctccccgtcctctgtctaacctcaccctctaaacgttcagcggtggaaagatttttataattttaaattattactgctttgaaataaacggacgtttgagctcacgtggcggccatgcatggtttgtggcggaagacggggcccagcggctcccccagcgctgaagcacggggttcagcggctcccccagtgctgcaggtgccgccaggacgggccacgtgggcccccagcctccccctcggccgcctccacgacccggagtaggggggctcgggaccatgaggatgaccagcaaaattcaagaacaaaactgctccaacagacttttttaaaggaaaaaatatgtgtatcttgaaagctatttaaaatacactacttacaaagagaa

SEQ ID NO: 72323 - DNA, 1641 bp, Homo sapiens
gtgcgtgagcgtgcgcgggcgcgtcggccggcgagggagcagcaaacggccggcggcgggtgccgcgcggggggcgggcggcgcggagtaggtggcggcggccatggccgaggcgtcgccgcatcccggacggtacttctgccactgctgctccgtggagatcgtcccgcgcctgccggattatatctgtccaagatgcgagtctggttttatcgaggagcttccggaagagaccaggagcacagaaaatggttctgccccctccacagctcccacagaccagagccggccaccgttggagcacgtggaccagcacctgttcacgctgccgcagggctacggacagtttgctttcggcatcttcgatgacagcttcgagatccccacgttccctcctggggcgcaggctgacgacggcagggaccctgagagccggcgggagagagaccatccgtcccggcaccggtacggcgcccgacagccccgcgcccgcctcaccacgcggcgggccaccggccggcacgaaggcgtccccacgctggaagggatcatccagcagctcgtcaacggcatcatcacgcccgccaccatccccagcctgggcccctggggagtcctgcactcaaaccctatggactacgcctggggggccaacggcctggatgccatcatcacacagctcctcaatcagtttgaaaacacaggccccccaccggcagataaagagaaaatccaggccctccccaccgtccccgtcactgaggagcacgtaggctccgggctcgagtgccctgtgtgcaaggacgactacgcgctgggtgagcgtgtgcggcagctgccctgcaaccacctgttccacgacggctgcatcgtgccctggctggagcagcacgacagctgccccgtctgccgaaaaagcctcacgggacagaacacggccacgaacccccctggcctcactggggtgagcttctcctcctcgtcgtcatcgtcctcctccagctcgcccagcaacgagaacgccacaagcaactcgtgagcccacgtcggccgtcgggaaagcacggggcctttcccacccaccctcagccagcgccacacggcacccacagactgggtgccccggcggcgccacgcttggctggtcagcgctgcaggtcccgcctgttccagggcaggacccgggcccggcccaccggccccctggcttgggaaggcgtgggccacatggtcccctctggggcgtccccagcctccccgtcctctgtctaacctcaccctctaaacgttcagcggtggaaagatttttataattttaaattattactgctttgaaataaacggacgtttgagctcacgtggcggccatgcatggtttgtggcggaagacggggcccagcggctcccccagcgctgaagcacggggttcagcggctcccccagtgctgcaggtgccgccaggacgggccacgtgggcccccagcctccccctcggccgcctccacgacccggagtaggggggctcgggaccatgaggatgaccagcaaaattcaagaacaaaactgctccaacagacttttttaaaggaaaaaatatgtgtatcttgaaagctatttaaaatacactacttacaaagagaa

SEQ ID NO: 72324 - DNA, 1152 bp, Homo sapiens
gtgcgtgagcgtgcgcgggcgcgtcggccggcgagggagcagcaaacggccggcggcgggtgccgcgcggggggcgggcggcgcggagtaggtggcggcggccatggccgaggcgtcgccgcatcccggacggtacttctgccactgctgctccgtggagatcgtcccgcgcctgccggattatatctgtccaagatgcgagtctggttttatcgaggagcttccggaagagaccaggagcacagaaaatggttctgccccctccacagctcccacagaccagagccggccaccgttggagcacgtggaccagcacctgttcacgctgccgcagggctacggacagtttgctttcggcatcttcgatgacagcttcgagatccccacgttccctcctggggcgcaggctgacgacggcagggaccctgagagccggcgggagagagaccatccgtcccggcaccggtacggcgcccgacagccccgcgcccgcctcaccacgcggcgggccaccggccggcacgaaggcgtccccacgctggaagggatcatccagcagctcgtcaacggcatcatcacgcccgccaccatccccagcctgggcccctggggagtcctgcactcaaaccctatggactacgcctggggggccaacggcctggatgccatcatcacacagctcctcaatcagtttgaaaacacaggccccccaccggcagataaagagaaaatccaggccctccccaccgtccccgtcactgaggagcacgtaggctccgggctcgagtgccctgtgtgcaaggacgactacgcgctgggtgagcgtgtgcggcagctgccctgcaaccacctgttccacgacggctgcatcgtgccctggctggagcagcacgacagctgccccgtctgccgaaaaagcctcacgggacagaacacggccacgaacccccctggcctcactggggtgagcttctcctcctcgtcgtcatcgtcctcctccagctcgcccagcaacgagaacgccactcccctctggggcgtccccagcctccccgtcctctgtctaacctcaccctctaaacgttcagcggtggaaagatttttataattttaaattattactgctttgaaataaacggacgtttgagctca

SEQ ID NO: 72325 - DNA, 1718 bp, Homo sapiens
gtgcgtgagcgtgcgcgggcgcgtcggccggcgagggagcagcaaacggccggcggcgggtgccgcgcggggggcgggcggcgcggagtaggtggcggcggccatggccgaggcgtcgccgcatcccggacggtacttctgccactgctgctccgtggagatcgtcccgcgcctgccggattatatctgtccaagatgcgagtctggttttatcgaggagcttccggaagagaccaggagcacagaaaatggttctgccccctccacagctcccacagaccagagccggccaccgttggagcacgtggaccagcacctgttcacgctgccgcagggctacggacagtttgctttcggcatcttcgatgacagcttcgagatccccacgttccctcctggggcgcaggctgacgacggcagggaccctgagagccggcgggagagagaccatccgtcccggcaccggtacggcgcccgacagccccgcgcccgcctcaccacgcggcgggccaccggccggcacgaaggcgtccccacgctggaagggatcatccagcagctcgtcaacggcatcatcacgcccgccaccatccccagcctgggcccctggggagtcctgcactcaaaccctatggactacgcctggggggccaacggcctggatgccatcatcacacaggtcctgcagcctcgcgtttcagagccccgggccgggcccccgaggagctcccggcactctcgcctcttgtctttcagctcctcaatcagtttgaaaacacaggccccccaccggcagataaagagaaaatccaggccctccccaccgtccccgtcactgaggagcacgtaggctccgggctcgagtgccctgtgtgcaaggacgactacgcgctgggtgagcgtgtgcggcagctgccctgcaaccacctgttccacgacggctgcatcgtgccctggctggagcagcacgacagctgccccgtctgccgaaaaagcctcacgggacagaacacggccacgaacccccctggcctcactggggtgagcttctcctcctcgtcgtcatcgtcctcctccagctcgcccagcaacgagaacgccacaagcaactcgtgagcccacgtcggccgtcgggaaagcacggggcctttcccacccaccctcagccagcgccacacggcacccacagactgggtgccccggcggcgccacgcttggctggtcagcgctgcaggtcccgcctgttccagggcaggacccgggcccggcccaccggccccctggcttgggaaggcgtgggccacatggtcccctctggggcgtccccagcctccccgtcctctgtctaacctcaccctctaaacgttcagcggtggaaagatttttataattttaaattattactgctttgaaataaacggacgtttgagctcacgtggcggccatgcatggtttgtggcggaagacggggcccagcggctcccccagcgctgaagcacggggttcagcggctcccccagtgctgcaggtgccgccaggacgggccacgtgggcccccagcctccccctcggccgcctccacgacccggagtaggggggctcgggaccatgaggatgaccagcaaaattcaagaacaaaactgctccaacagacttttttaaaggaaaaaatatgtgtatcttgaaagctatttaaaatacactacttacaaagagaa

SEQ ID NO: 72326 - DNA, 1466 bp, Homo sapiens
aatgttggttcgccagggagtatgatatcgtcgacccacgcgctccggagaccaggagcacagaaaatggttctgccccctccacagctcccacagaccagagccggccaccgttggagcacgtggaccagcacctgttcacgctgccgcagggctacggacagtttgctttcggcatcttcgatgacagcttcgagatccccacgttccctcctggggcgcaggctgacgacggcagggaccctgagagccggcgggagagagaccatccgtcccggcaccggtacggcgcccgacagccccgcgcccgcctcaccacgcggcgggccaccggccggcacgaaggcgtccccacgctggaagggatcatccagcagctcgtcaacggcatcatcacgcccgccaccatccccagcctgggcccctgcctgcactcaacacccgtatgtgacatacgcctgagagaagcccaacggtctggactgaccatcgatagccgaaaggctcctcaatcagtttgaaaacacaggccccccaccggcagataaagagaaaatccaggccctccccaccgtccccgtcactgaggagcacgtaggctccgggctcgagtgccctgtgtgcaaggacgactacgcgctgggtgagcgtgtgcggcagctgccctgcaaccacctgttccacgacggctgcatcgtgccctggctggagcagcacgacagctgccccgtctgccgaaaaagcctcacgggacagaacacggccacgaacccccctggcctcactggggtgagcttctcctcctcgtcgtcatcgtcctcctccagctcgcccagcaacgagaacgccacaagcaactcgtgagcccacgtcggccgtcgggaaagcacggggcctttcccacccaccctcagccagcgccacacggcacccacagactgggtgccccggcggcgccacgcttggctggtcagcgctgcaggtcccgcctgttccagggcaggacccgggcccggcccaccggccccctggcttgggaaggcgtgggccacatggtcccctctggggcgtccccagcctccccgtcctctgtctaacctcaccctctaaacgttcagcggtggaaagatttttataattttaaattattactgctttgaaataaacggacgtttgagctcacgtggcggccatgcatggtttgtggcggaagacggggcccagcggctcccccagcgctgaagcacggggttcagcggctcccccagtgctgcaggtgccgccaggacgggccacgtgggcccccagcctccccctcggccgcctccacgacccggagtaggggggctcgggaccatgaggatgaccagcaaaattcaagaacaaaactgctccaacagacttttttaaaggaaaaaatatgtgtatcttgaaagctatttaaaatacactacttacaaagagaa

SEQ ID NO: 72327 - DNA, 837 bp, Homo sapiens
taaccatagtgtgaaacgtagatgatagcagtattgtattagacaatgagacccagagcccctgtggactgacatgtttggagtagggaatcacaaagtgaatgccgagactgctaaaaggaaaagcatccggcaggccgcggacgatctccacggagcagcagtggcagaagtaccgtcgtcatcgtcctcctccagctcgcccagcaacgagaacgccacaagcaactcgtgagcccacgtcggccgtcgggaaagcacggggcctttcccacccaccctcagccagcgccacacggcacccacagactgggtgccccggcggcgccacgcttggctggtcagcgctgcaggtcccgcctgttccagggcaggacccgggcccggcccaccggccccctggcttgggaaggcgtgggccacatggtcccctctggggcgtccccagcctccccgtcctctgtctaacctcaccctctaaacgttcagcggtggaaagatttttataattttaaattattactgctttgaaataaacggacgtttgagctcacgtggcggccatgcatggtttgtggcggaagacggggcccagcggctcccccagcgctgaagcacggggttcagcggctcccccagtgctgcaggtgccgccaggacgggccacgtgggcccccagcctccccctcggccgcctccacgacccggagtaggggggctcgggaccatgaggatgaccagcaaaattcaagaacaaaactgctccaacagacttttttaaaggaaaaaatatgtgtatcttgaaagctatttaaaatacactacttacaaagagaa

SEQ ID NO: 72328 - DNA, 529 bp, Homo sapiens
atatttttttggcttttatgaattgtgccactgtgctccagcctgggtgacagagcgagagactgtctaaaaaacaacaaaaaaccaccccccacacaccattgtggcattattagttattttgagcagaagtcacttgagaaacggcagttgcaggaagggttccctgacctgctgtctccctaaaagcaggtaatacaatttcccatgagaaagtgccccttctgttccagaagagaagaacatccttactggagactgggagtagatgacgaaatggatctgtacaaacaaatctactgaaatactccttatcttccactcatatccaccatctatttcttagtcatgccacaatttactgcccttagcctaaagctctttatttgatcaattttccacaaatgtatcatttctttaaaaagtaaataagctcttgatcccaactgttctttgggtctctattctccatatgagggttcccttgattcaaataaaagattaaataaaatgtgtatgcttctctcct

SEQ ID NO: 72329 - DNA, 316 bp, Homo sapiens
ttgtggcacctaatgcgttcatattggtaggaacacagtaataggaaaggaagtttatctttctagttgggatttaagaaaactcttaaagatggaagaatattacctttttttgtttccttatctctttgtggaataaatgagtaaatactgtgactgcagtcacatgagataggtattagccatcagtctaactagaggatctaaggaaacacttcagaagtccaggagaacgaggcagcagtattgacagcagatagaggaagaagcagcagagtagatctggaagtggggagtgtttaaacaagagggctgg

SEQ ID NO: 72330 - DNA, 1627 bp, Homo sapiens
cagggacccaggcgctcagctgctggggccgcggagggcgttcgcggggcgccggggaaggctagggccgcggggtccccggggcgccgtcctccgaccgcctgaggctgggctgccggcaagccgcggcagcatatgacagcacttgaaagaaagtccctggaaagaatgtggatcattgcagaactccctcaagaaagcgccagaggaggaccccattcagcaccccgcagaactcctcaaactcctgcgtccacactcccccagcgtggtggctgcttctatctccccaggcttagctggcctgggtcttgaaggcctctcctcctgctgtccccacgcagcatcctctctgccactgcacagctggatgcagtgaaggccaggcggctgtggctgcttgggcaacaggagctgcttgaccctgttctgctggccttgttggcctcactcccgtagagagccaaggttacccacgtctctgaagctaaggctttctttctaggcctgggggagtcacatcttgcattcgtactcactgagctccacgtctatggccctggtgtgtgatgttgcccgcactgtgtccaagtgttctcattgttcaattcccacctgtgccaactcctgggatcttatcgggaagtggctcatcatcagctttaggtgttttctatctattgggagcctgcctttctctggcaccagctgcaaccaataattattttagacagtttaacaacagcttgaccatcacctgatgatcacctgacatttctgttggggcgcgggcccatctcctgccccgctcatgtggggctcagtctgcccaacctttccccaagggcctgtctttacttcatttgtggtaagccccaagcagaatggactcttgttatgatcccaggaactgctcacggccacctctgtggatgaacacctagcggctgctctaaatacatgctgtgaaagttgtcagaatcaaaatggagtcactaatgttaagaaagccctgacaaagagttggtggggaaggccacgaagagaggacacttatgcttgcatgcctgataccagaaaggactacaaaaaccacagcccggcacagaggccatcacacccttacacaaaaaatatttctgcaaggacaactgcccagcaattgcctgtccaacctcagactggaatgacctttgttattgatgtttgtagccaaggagaattatctcaaaaccactgtgatcctgctcgcttttcctttaaagacctttgtcttccttgacctccctgaataggcatatggtttactatggcgtgtgtactctccttgtaatgttctgttctcaagctaacatctattcttctagagaacctctctcttaggctgacaacgctgtggatctgggctcccaggaactggggctgacatcagaggggtggaaagagaacagcagctctccctgaggggatgcttgccaaggataaggagacgatggttctctaaggattattttatattcatctaaaagggtatttttgttgttacccctagccttttttcccttttaattttctgatgaataatttatataaagaaaacccattctaagtgtgcaaaaaaaaaaaa

SEQ ID NO: 72331 - DNA, 417 bp, Homo sapiens
tggtgcctcaggaagtctttgtcggcaaatctgagtatgctggaaagataggagcacataagactggttggcttgtatttgggggagaccgattgtgtcagatatgtatgtggaacgtagctgtccttgccgagtctgacctgtatgaaatgcatatccatggctatattattttggatttatggaggaagcagagcatttctgacacttaaggttgtatgcgtgagggagaaggctttcacagcttaacttgtaccagagcagctgcatgggtgctgacagcttaacttgaaatctgtgggaggaaggatcctttttcactcattcaacaaatataaccattcaatgaatggtccatgccttgaggtgaggatcatcaaggtgtctctgtaaatagcctggatgcaatctgagggg

SEQ ID NO: 72332 - DNA, 534 bp, Homo sapiens
  misc_feature (398)..(398): n is a, c, g, or t
  misc_feature (444)..(444): n is a, c, g, or t
  misc_feature (459)..(459): n is a, c, g, or t
  misc_feature (495)..(495): n is a, c, g, or t
  misc_feature (513)..(513): n is a, c, g, or t
  misc_feature (524)..(524): n is a, c, g, or t
tggtgcctcaggaagtctttgtcggcaaatctgagtatgctggaaagataggagcacataagactggttggcttgtatttgggggagaccgattgtgtcagatatgtatgtggaacgtagctgtccttgccgagtctgacctgtatgaaatgcatatccatggctatattattttggatttatggaggaagcagagcatttctgacacttaaggttgtatgcgtgagggagaaggctttcacagcttaacttgtaccagagcagctgcatgggtgctgacagcttaacttgaaatctgtgggaggaaggatcctttttcactcattcaacaaatataaccattcaatgaatggtccatgccttgaggtgaggatcatcaaggtgtctctaaacaactntttcccctggggattttaggagggaagttgttcaagatgggaaccncgaaggtgctacagngggatttcagtggggttttcttttgagctagggggnattaagggtcttggagantgggagccttnaattcgggcc

SEQ ID NO: 72333 - DNA, 464 bp, Homo sapiens
ttgtcttatttttaattttgatttttaaaataaaatttaccatctttactatgtttaagtgttagttgaatagtgttaagtatagtcacataagtcagtatacagttttaaacaatgtatataacaatatatattaaacataggaattttggactgaatgtttttatccctccctcccaatttctgtgttgaaatcctaacccccttatgatggtattaagaggtcggggctttgaaaggtcattaggtcatggaggtggagacttcatgaatgggattagtgcccttataaaaggaaccccatagagctctctagctctccttctgccatataaaggtacaatgagaagtcagctgtctgtggcccagaagagtcctcatcagaccctgaccaggctggcatcctaatctcagacttccagcctttagaattgtaggaaataaatttctgttgtttatgagcc

SEQ ID NO: 72334 - DNA, 1286 bp, Homo sapiens
gtacacatgagcacaaagacaccaacaggaggaagggaaagaggaaaggaggaaagggctgaaaagcttcctttcaggtactctgctcagtacctagctgacaggattaatagaagcccaagcctcagcatcatgcaatatatccttgtaacaaacctgtatgtgtaccccctgaatctaaaattaaaatgaaaggagaatattttacttttcttaagtaaaattgtgttttaacacaaatagaatcttttcaaacacaatatatcttaaagctctttcctcattttatttaataactatggaaatttttttgtttaactgtttgctgttgatgaatatgtttctagtttgaagatatatcaagcaatgccatggtgatcatccctatgtatattttgacatacttttgtgattgcttagaaaagataaattcctagcattgaagttgttaggtcaaaggacatgtgcactttttagtgttaatagattttatccagtttttttcagtttatcccttttttcttggtaacatataagtactcataagattaattcttcagtttatcatcttttaaaaacttgtatttttacgtgctcacagccggacctgaaggaagcagttgtttagtctactttgagaacacattgccattctagttttctgatacccagggacatgctgtggttttacaaccagcctagtggtagttctcacccatccatttctacttttatccttcatctgagcatctgtgaaagcctcttcagggctttctttattttgtctcttgactctcctaaatccactgttgccacagcagccaaagtgatccatttaaaatgtaaatcatattaattcactcactcaacacactcattgagagcttactgtgtgccaggcactgttccagcctttaggagatggctgtttaaagccaagtccctgctcacagtatattgggtaggacagggcagctatcaagagaacaaagatatggccgagcatggtgccttacgtctgtaatctcagtatttcaggaggccagggcaatctcttaatgccaggaattcaagactagcctaggcagcatagcaagacaccatccctccaaaaataaataaatataagttagcggggcatggtggtacacatctgtagtcccagctacttgggaggctgaggcaggagaatcacttgaacccaggagttcgaggctgcggtgagctatatgattgcaccaccacactctagccctagcaacagagtgagatgctgtgtctaaaaa

SEQ ID NO: 72335 - DNA, 1282 bp, Homo sapiens
gtacacatgagcacaaagacaccaacaggaggaagggaaagaggaaaggaggaaagggctgaaaagcttcctttcaggtactctgctcagtacctagctgacaggattaatagaagcccaagcctcagcatcatgcaatatatccttgtaacaaacctgtatgtgtaccccctgaatctaaaattaaaatgaaaggagaatattttacttttcttaagtaaaattgtgttttaacacaaatagaatcttttcaaacacaatatatcttaaagctctttcctcattttatttaataactatggaaatttttttgtttaactgtttgctgttgatgaatatgtttctagtttgaagatatatcaagcaatgccatggtgatcatccctatgtatattttgacatacttttgtgattgcttagaaaagataaattcctagcattgaagttgttaggtcaaaggacatgtgcactttttagtgttaatagattttatccagtttttttcagtttatcccttttttcttggtaacatataagtactcataagattaattcttcagtttatcatcttttaaaaacttgtatttttacgtgctcacagccggacctgaaggaagcagttgtttagtctactttgagaacacattgccattctagttttctgatacccagggacatgctgtggttttacaaccagcctagtggtagttctcacccatccatttctacttttatccttcatctgagcatctgtgaaagcctcttcagggctttctttattttgtctcttgactctcctaaatccactgttgccacagcagccaaagtgatccatttaaaatgtaaatcatattaattcactcactcaacacactcattgagagcttactgtgtgccaggcactgttccagcctttaggagatggctgtttaaagccaagtccctgctcacagtatattgggtaggacagggcagctatcaagagaacaaagatatggccgagcatggtgccttacgtctgtaatctcagtatttcaggaggccagggcaatctcttaatgccaggaattcaagactagcctaggcagcatagcaagacaccatccctccaaaaataaataaatataagttagcggggcatggtggtacacatctgtagtcccagctacttgggaggctgaggcaggagaatcacttgaacccaggagttccacgctccccatgacctcccctcccgtgctgcaggggttttggagaaaaacaataaagagattctcactca

SEQ ID NO: 72336 - DNA, 664 bp, Homo sapiens
agcggacttttcaggggacattcagaggcatcagccccttcctcctcaccagctcccagagttcccatctccatccccaatcctaaagaaggaaatcgatgccacggtcctcaaggagccctggggacccaggcgccctactcgaagatgtggcccacaatcccagaccccggaggattgcccagcgaggccggaacaccagcaggatggcagaggacacctccccaaacatgaatgacaacatcctgttgcctgtccgcaacaatgaccaagccctaggcctgactcagtgcatgctgggatgtgtgtcctggttcacctgttttgcctgctccctgagaactcaggcccagcaggttctgtttaacacgtgcagatgcaagctgctgtgccagaagctcatggagaagacaggcattctgctcctctgtgctttcggtgtgtcccagggccctgcccagtcccaggtggaggtatccctgggccctggcactgattataggacactgggcaagacactgcactgccacgtgactcagtttccccatctgcctgatgggtgttgctgtgagaattatgaaatgaaatgatgaccatgaaaatattgtagaagccaagaaatgcttcagaagttataaagctctccccaaaccgtgttaaacat

SEQ ID NO: 72337 - DNA, 597 bp, Homo sapiens
agcggacttttcaggggacattcagaggcatcagccccttcctcctcaccagctcccagagttcccatctccatccccaatcctaaagaaggaaatcgatgccacggtcctcaaggagccctggggacccaggcgccctactcgaagatgtggcccacaatcccagaccccggaggattgcccagcgaggccggaacaccagcaggatggcagaggacacctccccaaacatgaatgacaacatcctgttgcctgtccgcaacaatgaccaagccctaggcctgactcagtgcatgctgggatgtgtgtatgcaagctgctgtgccagaagctcatggagaagacaggcattctgctcctctgtgctttcggtgtgtcccagggccctgcccagtcccaggtggaggtatccctgggccctggcactgattataggacactgggcaagacactgcactgccacgtgactcagtttccccatctgcctgatgggtgttgctgtgagaattatgaaatgaaatgatgaccatgaaaatattgtagaagccaagaaatgcttcagaagttataaagctctccccaaaccgtgttaaacat

SEQ ID NO: 72338 - DNA, 779 bp, Homo sapiens
agcggacttttcaggggacattcagaggcatcagccccttcctcctcaccagctcccagagttcccatctccatccccaatcctaaagaaggaaatcgatgccacggtcctcaaggagccctggggacccaggcgccctactcgaagatgtggcccacaatcccagaccccggaggattgcccagcgaggccggaacaccagcaggatggcagaggacacctccccaaacatgaatgacaacatcctgttgcctgtccgcaacaatgaccaagccctaggcctgactcagtgcatgctgggatgtgtgtcctggttcacctgttttgcctgctccctgagaactcaggcccagcaggttctgtttaacacgtgcagatgcaagctgctgtgccagaagctcatggagaagacaggcattctgctcctctgtgctttcggattctggatgttttctattcacttaccatcgaaaatgaaagtctggcaggatgacagcataaatggtccactgcagagcttgaggttgtaccaggagaaggtgcgacatcacagtggggaaatccaggacctccgaggtagcatgaaccagctcattgccaagctccaggagatggaagccatgtccgatgagcaaaaaatggcccagaaaataatgaagatgatacacggagattacatcgaaaagccagactttgccctgaagtctatagaggggccagcattgactttgagcacacgtcagtcacctataaccatgagaaggcccactcctactgga

SEQ ID NO: 72339 - DNA, 281 bp, Homo sapiens
taaacccggccgaaggggtgcccctgagaccactggcagtccaggcagttgttcattcctagtaaatgtacctgtttattttgtccttatctttccttcctcttccattgtgccacccatctagtttctcctggcctgtacctgaggcctgcttccaaggatgtgcctggcccactccccaaggtcctcagcagtcctgtatttcgggccctgcttgcagtgggaacccaaatggtacactatcctcctctttactgaacatcattaaaattctattttga

SEQ ID NO: 72340 - DNA, 471 bp, Homo sapiens
acttctttttattgtaatgtatttgaaatgtacagaacatgtggtgagtaatatagtaaactccatacacctactagccagatcaatagaactaaacattttaccatcttcagtctaatgttattgctgagaaagtaaaacataggatggagttgaagctctctgtgtaaccatcccttgatctcactgccttggtctttcccttagagatcaacactgtcctgaatttggtgtttgctacttccatgcatattatcctacgattatttcatatctatgtatagacacacacacacacacacacacacacacttacaatacataccctattttaaaatttcatgtaagtgattttctattgtaaataatgtcctgcaacttattttcatttcattttattttcttaggaaggatgagatagagggagcattgtctgcattaaatttataataaaaatctattggattctct

SEQ ID NO: 72341 - DNA, 539 bp, Homo sapiens
  misc_feature (482)..(482): n is a, c, g, or t
  misc_feature (530)..(530): n is a, c, g, or t
gttcgtgctgaaggcctgtatcctaggctacacactgaggactctgttcctcccctttccgcctaggggaaagtccccggacctcgggcagagagtgccacgtgcatacgcacgtagacattccccgcttcccactccaaagtccgccaagaagcgtatcccgctgagcggcgtggcgcgggggcgtcatccgtcagctccctctagttacgcaggcagtgcgtgtccgcgcaccaaccacacggggctcattctcagcgcgcccgcctacagccgcgcgcttcagccggaaactcagcagcggggtctcggagatccggcacactgcggaccgctgggcgcgtgtccctggatgtcaacacttgccccggacgagctgacggtcaagaccaaggatggcgtggtggagatcaccggcaagcacgaggaagcggcaggaacgagcatggctacatctcccggtgcttcacgcggaaatacangctgcccccccggtgtggaccccaaccaagttttcctccttccctgtncccctgaag

SEQ ID NO: 72342 - DNA, 812 bp, Homo sapiens
  misc_feature (3)..(4): n is a, c, g, or t
  misc_feature (11)..(11): n is a, c, g, or t
  misc_feature (17)..(17): n is a, c, g, or t
  misc_feature (22)..(22): n is a, c, g, or t
  misc_feature (24)..(24): n is a, c, g, or t
  misc_feature (26)..(26): n is a, c, g, or t
  misc_feature (28)..(28): n is a, c, g, or t
  misc_feature (35)..(37): n is a, c, g, or t
ggnncgggccnagccgnagccncncngnccgcgcnnnccgccggccccacccatccgggtcgaggaggccgaggccatggctgagacggaggagcggagcctggacaacttctttgccaagagggacaagaagaagaagaaggagcggagcaaccgggcggcgagtgccgcgggcgcagcgggcagcgccggcggaagcagtggagccgcgggtgcggcgggcggcggggcgggcgcggggacccggccgggtgacggcgggaccgccagcgcgggggctgcgggcccaggggccgccaccaaggctgtgacgaaggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaacaggtacttaaaatgaatgctacctggaattaaatgactacatatggcacatctacatcttactttagggacatgaattttttaaaataaataaaatgggaagaaatgta

SEQ ID NO: 72343 - DNA, 356 bp, Homo sapiens
  misc_feature (327)..(327): n is a, c, g, or t
  misc_feature (333)..(333): n is a, c, g, or t
gtacccttccaacatctcatttctgatttaatcatcgacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagaaatgagatgtggaagggggatgntctagngtcaaatggggcatcaaaatgca

SEQ ID NO: 72344 - DNA, 3334 bp, Homo sapiens
ggcacgagctggctcgcgcgtgccttttcccctcaggttgtggggagagcggaatcctgctccgccgtcgcagcagcagcggcagccccggcagcctcgggcgacagcggcggcgcgcgagcccccgggcggaccgtaccaccgctcgccagcacgcagggggagccgcccgtctcgccgcgcacgcctcggcgaccccgcggggctgaggcgtcgccgcgcccggcagcgtgagcgcagagccggcctcgaccccgagctcggagccccgcgggccgcgcccgccgccggccccacccatccgggtcgaggaggccgaggccatggctgagacggaggagcggagcctggacaacttctttgccaagagggacaagaagaagaagaaggagcggagcaaccgggcggcgagtgccgcgggcgcagcgggcagcgccggcggaagcagtggagccgcgggtgcggcgggcggcggggcgggcgcggggacccggccgggtgacggcgggaccgccagcgcgggggctgcgggcccaggggccgccaccaaggctgtgacgaaggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaaggataaagaaatggagaagagctttgaagtagtaagacacaaaaatagaggtagggatgaggtttcaaaaaaccaggcccttaaacttcagctagacaaccaatatgctgtgcttgaaaatcagaaaagcagccactcacaatacaattaaggaatgggctttgctaacccttctgaggtaactagactgcagctaaccaccaccaacagccattcatcatctgatctctgctggatctacagacaccgatgcagaccactcgatttcatgaccggccctattgcactatggaagttaaagtgtcacgactgctctatgcatattggatttaggggaattttcattgttacataaatgtgtgaactagtttcaacagtgttctttcatatttactctgcaaatacaaaaaaccaaaacctgcagccagtggtcatttcaaaatctttttatgttcagatactgagccttcataagggttgactacctcagatttgctgcactcattgtggacttcatgtggatcacaacttctggataagaagattacaactattaagtgtcgatgtgaaccttgcaaccagctctactggattcttatcagaaatcctgcataaaaagtcagccatctgggttctgatctgctgtaaaagatgaagatttaagtgaccttaattaacctgtcctgtgccctacccttaaggaatactctctgtagtaggctgttgttatattagacttcctggaacacaccgctgaaaagaactgatgtgttcagatcatctgtgtagggctgtgatttgtaatttaaactaattgtattctgaggtaaccacaaaataaattcaaccaaactggggtccaccaagtgggggaaggggaagggagagaataatcttgggggtttttttttttggtaatttttttatttggatagtgcttttttgttttgtttttgttctgcattaaggccttttttgctttgacttgaaataagttctttgacagagcatattgcttggttaattaagtaacctaaagtatgcattaggattgtgaaatgtctcgtgagtatgccaatcctgagggtggaaccaaatagcctttgatgaaaagggcagtggattctggaggctctacttcaggtgctgctataatgcctcatctaatcaggactaaattgtgtaggaaactgcagtgggaagaatatgctttctgctcaggctaagagggtcactgatctgtccttagaaattcagagtaacatgagcaaaacctcagctaaaacccatttaagtggcatggattgtgcatgatctttgataagaattcctcatgtacttgtgcctagtttttcaaggtattggctgttctatagatgcagtgattgtcccagctagctctgttaccagccttttggtgtgtctttatgttcatttggagagtcagggcgaaagacaggtgatgtagcacttctgtttttaataattattgcttaaaatacctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattctcaggcatggtttggcagtgcaagaattctgtaacattaacaaattcaataaaaagtaaatatatggattttggactgtaaaaaaaaa

SEQ ID NO: 72345 - DNA, 2894 bp, Homo sapiens
acctcgggctgggctcgccagggccgggaccccttccgatatccgcggtggagccgcccttcccaccccgcgtcgctcggcgttagccaaggcccgggcggcgccaccctccgggggcactaggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaaggataaagaaatggagaagagctttgaagtagtaagacacaaaaatagaggtagggatgaggtttcaaaaaaccaggcccttaaacttcagctagacaaccaatatgctgtgcttgaaaatcagaaaagcagccactcacaatacaattaaggaatgggctttgctaacccttctgaggtaactagactgcagctaaccaccaccaacagccattcatcatctgatctctgctggatctacagacaccgatgcagaccactcgatttcatgaccggccctattgcactatggaagttaaagtgtcacgactgctctatgcatattggatttaggggaattttcattgttacataaatgtgtgaactagtttcaacagtgttctttcatatttactctgcaaatacaaaaaaccaaaacctgcagccagtggtcatttcaaaatctttttatgttcagatactgagccttcataagggttgactacctcagatttgctgcactcattgtggacttcatgtggatcacaacttctggataagaagattacaactattaagtgtcgatgtgaaccttgcaaccagctctactggattcttatcagaaatcctgcataaaaagtcagccatctgggttctgatctgctgtaaaagatgaagatttaagtgaccttaattaacctgtcctgtgccctacccttaaggaatactctctgtagtaggctgttgttatattagacttcctggaacacaccgctgaaaagaactgatgtgttcagatcatctgtgtagggctgtgatttgtaatttaaactaattgtattctgaggtaaccacaaaataaattcaaccaaactggggtccaccaagtgggggaaggggaagggagagaataatcttgggggtttttttttttggtaatttttttatttggatagtgcttttttgttttgtttttgttctgcattaaggccttttttgctttgacttgaaataagttctttgacagagcatattgcttggttaattaagtaacctaaagtatgcattaggattgtgaaatgtctcgtgagtatgccaatcctgagggtggaaccaaatagcctttgatgaaaagggcagtggattctggaggctctacttcaggtgctgctataatgcctcatctaatcaggactaaattgtgtaggaaactgcagtgggaagaatatgctttctgctcaggctaagagggtcactgatctgtccttagaaattcagagtaacatgagcaaaacctcagctaaaacccatttaagtggcatggattgtgcatgatctttgataagaattcctcatgtacttgtgcctagtttttcaaggtattggctgttctatagatgcagtgattgtcccagctagctctgttaccagccttttggtgtgtctttatgttcatttggagagtcagggcgaaagacaggtgatgtagcacttctgtttttaataattattgcttaaaatacctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattctcaggcatggtttggcagtgcaagaattctgtaacattaacaaattcaataaaaagtaaatatatggattttggactgtaaaaaaaaa

SEQ ID NO: 72346 - DNA, 4070 bp, Homo sapiens
ggcacgagctggctcgcgcgtgccttttcccctcaggttgtggggagagcggaatcctgctccgccgtcgcagcagcagcggcagccccggcagcctcgggcgacagcggcggcgcgcgagcccccgggcggaccgtaccaccgctcgccagcacgcagggggagccgcccgtctcgccgcgcacgcctcggcgaccccgcggggctgaggcgtcgccgcgcccggcagcgtgagcgcagagccggcctcgaccccgagctcggagccccgcgggccgcgcccgccgccggccccacccatccgggtcgaggaggccgaggccatggctgagacggaggagcggagcctggacaacttctttgccaagagggacaagaagaagaagaaggagcggagcaaccgggcggcgagtgccgcgggcgcagcgggcagcgccggcggaagcagtggagccgcgggtgcggcgggcggcggggcgggcgcggggacccggccgggtgacggcgggaccgccagcgcgggggctgcgggcccaggggccgccaccaaggctgtgacgaaggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaacaggtacttaaaatgaatgctacctggaattaaatgactacatatggcacatctacatcttactttagggacatgaattttttaaaataaataaaatgggaagaaatgtaaatgacatcagatggaaatgtgtttttggggtggcttttagaataaatcccagccttttcaccactttgagagcacagctggcttgaatttaaacctccacgtggacttgctcctctgctctgtcttaaaaaatgtgtaagggaccttgggagggcagtgattcaccacactcgagtttctttacctgatctaatcagatccactcccacaaaatcgatgtgaggagaaatcattgactaatgagtagaatttacttgaatgagaaaattgttacccttgtgcataaagagagagatgtattatctattacttgctaaaagtaagagtcttaggaggaatgtcattacacagcttttaacagttttcttcaagtttgtcctgaaatagggtcacagttaatactgttcagtagaagataggaccctagagcttcaatacagcgttctgtgttttctgtttgaattgaagccttaaaatggtttgataaggattttctatatgcctccactcctacccctccccaggattcttctaaggggtggcttttttttaaattcaaggacgaatattttcaaaaaccctagtgaagaagaaatatttactgattacatttcttttcccttagggataaagaaatggagaagagctttgaagtagtaagacacaaaaatagaggtagggatgaggtttcaaaaaaccaggcccttaaacttcagctagacaaccaatatgctgtgcttgaaaatcagaaaagcagccactcacaatacaattaaggaatgggctttgctaacccttctgaggtaactagactgcagctaaccaccaccaacagccattcatcatctgatctctgctggatctacagacaccgatgcagaccactcgatttcatgaccggccctattgcactatggaagttaaagtgtcacgactgctctatgcatattggatttaggggaattttcattgttacataaatgtgtgaactagtttcaacagtgttctttcatatttactctgcaaatacaaaaaaccaaaacctgcagccagtggtcatttcaaaatctttttatgttcagatactgagccttcataagggttgactacctcagatttgctgcactcattgtggacttcatgtggatcacaacttctggataagaagattacaactattaagtgtcgatgtgaaccttgcaaccagctctactggattcttatcagaaatcctgcataaaaagtcagccatctgggttctgatctgctgtaaaagatgaagatttaagtgaccttaattaacctgtcctgtgccctacccttaaggaatactctctgtagtaggctgttgttatattagacttcctggaacacaccgctgaaaagaactgatgtgttcagatcatctgtgtagggctgtgatttgtaatttaaactaattgtattctgaggtaaccacaaaataaattcaaccaaactggggtccaccaagtgggggaaggggaagggagagaataatcttgggggtttttttttttggtaatttttttatttggatagtgcttttttgttttgtttttgttctgcattaaggccttttttgctttgacttgaaataagttctttgacagagcatattgcttggttaattaagtaacctaaagtatgcattaggattgtgaaatgtctcgtgagtatgccaatcctgagggtggaaccaaatagcctttgatgaaaagggcagtggattctggaggctctacttcaggtgctgctataatgcctcatctaatcaggactaaattgtgtaggaaactgcagtgggaagaatatgctttctgctcaggctaagagggtcactgatctgtccttagaaattcagagtaacatgagcaaaacctcagctaaaacccatttaagtggcatggattgtgcatgatctttgataagaattcctcatgtacttgtgcctagtttttcaaggtattggctgttctatagatgcagtgattgtcccagctagctctgttaccagccttttggtgtgtctttatgttcatttggagagtcagggcgaaagacaggtgatgtagcacttctgtttttaataattattgcttaaaatacctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattctcaggcatggtttggcagtgcaagaattctgtaacattaacaaattcaataaaaagtaaatatatggattttggactgtaaaaaaaaa

SEQ ID NO: 72347 - DNA, 3422 bp, Homo sapiens
actagttctagatcgcgatctagaactagtccggacgcgtgggctgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaacaggtacttaaaatgaatgctacctggaattaaatgactacatatggcacatctacatcttactttagggacatgaattttttaaaataaataaaatgggaagaaatgtaaatgacatcagatggaaatgtgtttttggggtggcttttagaataaatcccagccttttcaccactttgagagcacagctggcttgaatttaaacctccacgtggacttgctcctctgctctgtcttaaaaaatgtgtaagggaccttgggagggcagtgattcaccacactcgagtttctttacctgatctaatcagatccactcccacaaaatcgatgtgaggagaaatcattgactaatgagtagaatttacttgaatgagaaaattgttacccttgtgcataaagagagagatgtattatctattacttgctaaaagtaagagtcttaggaggaatgtcattacacagcttttaacagttttcttcaagtttgtcctgaaatagggtcacagttaatactgttcagtagaagataggaccctagagcttcaatacagcgttctgtgttttctgtttgaattgaagccttaaaatggtttgataaggattttctatatgcctccactcctacccctccccaggattcttctaaggggtggcttttttttaaattcaaggacgaatattttcaaaaaccctagtgaagaagaaatatttactgattacatttcttttcccttagggataaagaaatggagaagagctttgaagtagtaagacacaaaaatagaggtagggatgaggtttcaaaaaaccaggcccttaaacttcagctagacaaccaatatgctgtgcttgaaaatcagaaaagcagccactcacaatacaattaaggaatgggctttgctaacccttctgaggtaactagactgcagctaaccaccaccaacagccattcatcatctgatctctgctggatctacagacaccgatgcagaccactcgatttcatgaccggccctattgcactatggaagttaaagtgtcacgactgctctatgcatattggatttaggggaattttcattgttacataaatgtgtgaactagtttcaacagtgttctttcatatttactctgcaaatacaaaaaaccaaaacctgcagccagtggtcatttcaaaatctttttatgttcagatactgagccttcataagggttgactacctcagatttgctgcactcattgtggacttcatgtggatcacaacttctggataagaagattacaactattaagtgtcgatgtgaaccttgcaaccagctctactggattcttatcagaaatcctgcataaaaagtcagccatctgggttctgatctgctgtaaaagatgaagatttaagtgaccttaattaacctgtcctgtgccctacccttaaggaatactctctgtagtaggctgttgttatattagacttcctggaacacaccgctgaaaagaactgatgtgttcagatcatctgtgtagggctgtgatttgtaatttaaactaattgtattctgaggtaaccacaaaataaattcaaccaaactggggtccaccaagtgggggaaggggaagggagagaataatcttgggggtttttttttttggtaatttttttatttggatagtgcttttttgttttgtttttgttctgcattaaggccttttttgctttgacttgaaataagttctttgacagagcatattgcttggttaattaagtaacctaaagtatgcattaggattgtgaaatgtctcgtgagtatgccaatcctgagggtggaaccaaatagcctttgatgaaaagggcagtggattctggaggctctacttcaggtgctgctataatgcctcatctaatcaggactaaattgtgtaggaaactgcagtgggaagaatatgctttctgctcaggctaagagggtcactgatctgtccttagaaattcagagtaacatgagcaaaacctcagctaaaacccatttaagtggcatggattgtgcatgatctttgataagaattcctcatgtacttgtgcctagtttttcaaggtattggctgttctatagatgcagtgattgtcccagctagctctgttaccagccttttggtgtgtctttatgttcatttggagagtcagggcgaaagacaggtgatgtagcacttctgtttttaataattattgcttaaaatacctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattctcaggcatggtttggcagtgcaagaattctgtaacattaacaaattcaataaaaagtaaatatatggattttggactgtaaaaaaaaa

SEQ ID NO: 72348 - DNA, 4506 bp, Homo sapiens
ggcacgagctggctcgcgcgtgccttttcccctcaggttgtggggagagcggaatcctgctccgccgtcgcagcagcagcggcagccccggcagcctcgggcgacagcggcggcgcgcgagcccccgggcggaccgtaccaccgctcgccagcacgcagggggagccgcccgtctcgccgcgcacgcctcggcgaccccgcggggctgaggcgtcgccgcgcccggcagcgtgagcgcagagccggcctcgaccccgagctcggagccccgcgggccgcgcccgccgccggccccacccatccgggtcgaggaggccgaggccatggctgagacggaggagcggagcctggacaacttctttgccaagagggacaagaagaagaagaaggagcggagcaaccgggcggcgagtgccgcgggcgcagcgggcagcgccggcggaagcagtggagccgcgggtgcggcgggcggcggggcgggcgcggggacccggccgggtgacggcgggaccgccagcgcgggggctgcgggcccaggggccgccaccaaggctgtgacgaaggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaagtaagtactataattaattgcattttgtttgggacttctgttcctaggccagggagtgggatataggggatgtgcatacccacccaagggagagactactccttaactaataaagcctgagcttcagctgacaggcaggtgagaatcagggtgggacttcatatgtccagaagggaggaaagggggagggcaaagagcattggagacactttgtcttctgtctgcaaaagtttatcttagccctggtttatgttgttttatagcaatgacaagttttaatgtagttaaaattcttttataattaagtggcttttgctccttataatatggaaactagaaatataaaagcgctgtttaattgtattcccagttaatgtgactatagacagaagatgttggcatttataaatctaatattaaaataatcttatttcagcaggtacttaaaatgaatgctacctggaattaaatgactacatatggcacatctacatcttactttagggacatgaattttttaaaataaataaaatgggaagaaatgtaaatgacatcagatggaaatgtgtttttggggtggcttttagaataaatcccagccttttcaccactttgagagcacagctggcttgaatttaaacctccacgtggacttgctcctctgctctgtcttaaaaaatgtgtaagggaccttgggagggcagtgattcaccacactcgagtttctttacctgatctaatcagatccactcccacaaaatcgatgtgaggagaaatcattgactaatgagtagaatttacttgaatgagaaaattgttacccttgtgcataaagagagagatgtattatctattacttgctaaaagtaagagtcttaggaggaatgtcattacacagcttttaacagttttcttcaagtttgtcctgaaatagggtcacagttaatactgttcagtagaagataggaccctagagcttcaatacagcgttctgtgttttctgtttgaattgaagccttaaaatggtttgataaggattttctatatgcctccactcctacccctccccaggattcttctaaggggtggcttttttttaaattcaaggacgaatattttcaaaaaccctagtgaagaagaaatatttactgattacatttcttttcccttagggataaagaaatggagaagagctttgaagtagtaagacacaaaaatagaggtagggatgaggtttcaaaaaaccaggcccttaaacttcagctagacaaccaatatgctgtgcttgaaaatcagaaaagcagccactcacaatacaattaaggaatgggctttgctaacccttctgaggtaactagactgcagctaaccaccaccaacagccattcatcatctgatctctgctggatctacagacaccgatgcagaccactcgatttcatgaccggccctattgcactatggaagttaaagtgtcacgactgctctatgcatattggatttaggggaattttcattgttacataaatgtgtgaactagtttcaacagtgttctttcatatttactctgcaaatacaaaaaaccaaaacctgcagccagtggtcatttcaaaatctttttatgttcagatactgagccttcataagggttgactacctcagatttgctgcactcattgtggacttcatgtggatcacaacttctggataagaagattacaactattaagtgtcgatgtgaaccttgcaaccagctctactggattcttatcagaaatcctgcataaaaagtcagccatctgggttctgatctgctgtaaaagatgaagatttaagtgaccttaattaacctgtcctgtgccctacccttaaggaatactctctgtagtaggctgttgttatattagacttcctggaacacaccgctgaaaagaactgatgtgttcagatcatctgtgtagggctgtgatttgtaatttaaactaattgtattctgaggtaaccacaaaataaattcaaccaaactggggtccaccaagtgggggaaggggaagggagagaataatcttgggggtttttttttttggtaatttttttatttggatagtgcttttttgttttgtttttgttctgcattaaggccttttttgctttgacttgaaataagttctttgacagagcatattgcttggttaattaagtaacctaaagtatgcattaggattgtgaaatgtctcgtgagtatgccaatcctgagggtggaaccaaatagcctttgatgaaaagggcagtggattctggaggctctacttcaggtgctgctataatgcctcatctaatcaggactaaattgtgtaggaaactgcagtgggaagaatatgctttctgctcaggctaagagggtcactgatctgtccttagaaattcagagtaacatgagcaaaacctcagctaaaacccatttaagtggcatggattgtgcatgatctttgataagaattcctcatgtacttgtgcctagtttttcaaggtattggctgttctatagatgcagtgattgtcccagctagctctgttaccagccttttggtgtgtctttatgttcatttggagagtcagggcgaaagacaggtgatgtagcacttctgtttttaataattattgcttaaaatacctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattctcaggcatggtttggcagtgcaagaattctgtaacattaacaaattcaataaaaagtaaatatatggattttggactgtaaaaaaaaa

SEQ ID NO: 72349 - DNA, 3486 bp, Homo sapiens
  misc_feature (3294)..(3294): n is a, c, g, or t
ggcacgagctggctcgcgcgtgccttttcccctcaggttgtggggagagcggaatcctgctccgccgtcgcagcagcagcggcagccccggcagcctcgggcgacagcggcggcgcgcgagcccccgggcggaccgtaccaccgctcgccagcacgcagggggagccgcccgtctcgccgcgcacgcctcggcgaccccgcggggctgaggcgtcgccgcgcccggcagcgtgagcgcagagccggcctcgaccccgagctcggagccccgcgggccgcgcccgccgccggccccacccatccgggtcgaggaggccgaggccatggctgagacggaggagcggagcctggacaacttctttgccaagagggacaagaagaagaagaaggagcggagcaaccgggcggcgagtgccgcgggcgcagcgggcagcgccggcggaagcagtggagccgcgggtgcggcgggcggcggggcgggcgcggggacccggccgggtgacggcgggaccgccagcgcgggggctgcgggcccaggggccgccaccaaggctgtgacgaaggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaaggataaagaaatggagaagagctttgaagtagtaagacacaaaaatagaggtagggatgaggtttcaaaaaaccaggcccttaaacttcagctagacaaccaatatgctgtgcttgaaaatcagaaaagcagccactcacaatacaattaaggaatgggctttgctaacccttctgaggtaactagactgcagctaaccaccaccaacagccattcatcatctgatctctgctggatctacagacaccgatgcagaccactcgatttcatgaccggccctattgcactatggaagttaaagtgtcacgactgctctatgcatattggatttaggggaattttcattgttacataaatgtgtgaactagtttcaacagtgttctttcatatttactctgcaaatacaaaaaaccaaaacctgcagccagtggtcatttcaaaatctttttatgttcagatactgagccttcataagggttgactacctcagatttgctgcactcattgtggacttcatgtggatcacaacttctggataagaagattacaactattaagtgtcgatgtgaaccttgcaaccagctctactggattcttatcagaaatcctgcataaaaagtcagccatctgggttctgatctgctgtaaaagatgaagatttaagtgaccttaattaacctgtcctgtgccctacccttaaggaatactctctgtagtaggctgttgttatattagacttcctggaacacaccgctgaaaagaactgatgtgttcagatcatctgtgtagggctgtgatttgtaatttaaactaattgtattctgaggtaaccacaaaataaattcaaccaaactggggtccaccaagtgggggaaggggaagggagagaataatcttgggggtttttttttttggtaatttttttatttggatagtgcttttttgttttgtttttgttctgcattaaggccttttttgctttgacttgaaataagttctttgacagagcatattgcttggttaattaagtaacctaaagtatgcattaggattgtgaaatgtctcgtgagtatgccaatcctgagggtggaaccaaatagcctttgatgaaaagggcagtggattctggaggctctacttcaggtgctgctataatgcctcatctaatcaggactaaattgtgtaggaaactgcagtgggaagaatatgctttctgctcaggctaagagggtcactgatctgtccttagaaattcagagtaacatgagcaaaacctcagctaaaacccatttaagtggcatggattgtgcatgatctttgataagaattcctcatgtacttgtgcctagtttttcaaggtattggctgttctatagatgcagtgattgtcccagctagctctgttaccagccttttggtgtgtctttatgttcatttggagagtcagggcgaaagacaggtgatgtagcacttctgtttttaataattattgcttaaaatacctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattctcaggcatggtttggcagtgcaagaattctgtaacattaacaaattcntaaagtatttttggcacacaaaaaaaaaagggcgggctaaaattcccgggcaattcggtccagttttaaaaggcccacagggataaaaagaggccgtaacagcaggagaagcaggctttaaacccggggttagacacacaaaccggaaagacgaagtccggcgataaaaaaaaaagggctattgtaactcaa

SEQ ID NO: 72350 - DNA, 2576 bp, Homo sapiens
ccggctacgtgcccgaggatgggctcaccgcgcagcagctcttcgccagcgccgacggcctcacctacaacgacttcctgattctcccaggattcttctaaggggtggcttttttttaaattcaaggacgaatattttcaaaaaccctagtgaagaagaaatatttactgattacatttcttttcccttagggataaagaaatggagaagagctttgaagtagtaagacacaaaaatagaggtagggatgaggtttcaaaaaaccaggcccttaaacttcagctagacaaccaatatgctgtgcttgaaaatcagaaaagcagccactcacaatacaattaaggaatgggctttgctaacccttctgaggtaactagactgcagctaaccaccaccaacagccattcatcatctgatctctgctggatctacagacaccgatgcagaccactcgatttcatgaccggccctattgcactatggaagttaaagtgtcacgactgctctatgcatattggatttaggggaattttcattgttacataaatgtgtgaactagtttcaacagtgttctttcatatttactctgcaaatacaaaaaaccaaaacctgcagccagtggtcatttcaaaatctttttatgttcagatactgagccttcataagggttgactacctcagatttgctgcactcattgtggacttcatgtggatcacaacttctggataagaagattacaactattaagtgtcgatgtgaaccttgcaaccagctctactggattcttatcagaaatcctgcataaaaagtcagccatctgggttctgatctgctgtaaaagatgaagatttaagtgaccttaattaacctgtcctgtgccctacccttaaggaatactctctgtagtaggctgttgttatattagacttcctggaacacaccgctgaaaagaactgatgtgttcagatcatctgtgtagggctgtgatttgtaatttaaactaattgtattctgaggtaaccacaaaataaattcaaccaaactggggtccaccaagtgggggaaggggaagggagagaataatcttgggggtttttttttttggtaatttttttatttggatagtgcttttttgttttgtttttgttctgcattaaggccttttttgctttgacttgaaataagttctttgacagagcatattgcttggttaattaagtaacctaaagtatgcattaggattgtgaaatgtctcgtgagtatgccaatcctgagggtggaaccaaatagcctttgatgaaaagggcagtggattctggaggctctacttcaggtgctgctataatgcctcatctaatcaggactaaattgtgtaggaaactgcagtgggaagaatatgctttctgctcaggctaagagggtcactgatctgtccttagaaattcagagtaacatgagcaaaacctcagctaaaacccatttaagtggcatggattgtgcatgatctttgataagaattcctcatgtacttgtgcctagtttttcaaggtattggctgttctatagatgcagtgattgtcccagctagctctgttaccagccttttggtgtgtctttatgttcatttggagagtcagggcgaaagacaggtgatgtagcacttctgtttttaataattattgcttaaaatacctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattctcaggcatggtttggcagtgcaagaattctgtaacattaacaaattcaataaaaagtaaatatatggattttggactgtaaaaaaaaa

SEQ ID NO: 72351 - DNA, 2396 bp, Homo sapiens
ggtcatccgtctaccaaagcaggaggatagagctttgaagtagtaagacacaaaaatagaggtagggatgaggtttcaaaaaaccaggcccttaaacttcagctagacaaccaatatgctgtgcttgaaaatcagaaaagcagccactcacaatacaattaaggaatgggctttgctaacccttctgaggtaactagactgcagctaaccaccaccaacagccattcatcatctgatctctgctggatctacagacaccgatgcagaccactcgatttcatgaccggccctattgcactatggaagttaaagtgtcacgactgctctatgcatattggatttaggggaattttcattgttacataaatgtgtgaactagtttcaacagtgttctttcatatttactctgcaaatacaaaaaaccaaaacctgcagccagtggtcatttcaaaatctttttatgttcagatactgagccttcataagggttgactacctcagatttgctgcactcattgtggacttcatgtggatcacaacttctggataagaagattacaactattaagtgtcgatgtgaaccttgcaaccagctctactggattcttatcagaaatcctgcataaaaagtcagccatctgggttctgatctgctgtaaaagatgaagatttaagtgaccttaattaacctgtcctgtgccctacccttaaggaatactctctgtagtaggctgttgttatattagacttcctggaacacaccgctgaaaagaactgatgtgttcagatcatctgtgtagggctgtgatttgtaatttaaactaattgtattctgaggtaaccacaaaataaattcaaccaaactggggtccaccaagtgggggaaggggaagggagagaataatcttgggggtttttttttttggtaatttttttatttggatagtgcttttttgttttgtttttgttctgcattaaggccttttttgctttgacttgaaataagttctttgacagagcatattgcttggttaattaagtaacctaaagtatgcattaggattgtgaaatgtctcgtgagtatgccaatcctgagggtggaaccaaatagcctttgatgaaaagggcagtggattctggaggctctacttcaggtgctgctataatgcctcatctaatcaggactaaattgtgtaggaaactgcagtgggaagaatatgctttctgctcaggctaagagggtcactgatctgtccttagaaattcagagtaacatgagcaaaacctcagctaaaacccatttaagtggcatggattgtgcatgatctttgataagaattcctcatgtacttgtgcctagtttttcaaggtattggctgttctatagatgcagtgattgtcccagctagctctgttaccagccttttggtgtgtctttatgttcatttggagagtcagggcgaaagacaggtgatgtagcacttctgtttttaataattattgcttaaaatacctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattctcaggcatggtttggcagtgcaagaattctgtaacattaacaaattcaataaaaagtaaatatatggattttggactgtaaaaaaaaa

SEQ ID NO: 72352 - DNA, 2199 bp, Homo sapiens
ctctagaggcccccatctgcctatccattcatcatctgatctctgctggatctacagacaccgatgcagaccactcgatttcatgaccggccctattgcactatggaagttaaagtgtcacgactgctctatgcatattggatttaggggaattttcattgttacataaatgtgtgaactagtttcaacagtgttctttcatatttactctgcaaatacaaaaaaccaaaacctgcagccagtggtcatttcaaaatctttttatgttcagatactgagccttcataagggttgactacctcagatttgctgcactcattgtggacttcatgtggatcacaacttctggataagaagattacaactattaagtgtcgatgtgaaccttgcaaccagctctactggattcttatcagaaatcctgcataaaaagtcagccatctgggttctgatctgctgtaaaagatgaagatttaagtgaccttaattaacctgtcctgtgccctacccttaaggaatactctctgtagtaggctgttgttatattagacttcctggaacacaccgctgaaaagaactgatgtgttcagatcatctgtgtagggctgtgatttgtaatttaaactaattgtattctgaggtaaccacaaaataaattcaaccaaactggggtccaccaagtgggggaaggggaagggagagaataatcttgggggtttttttttttggtaatttttttatttggatagtgcttttttgttttgtttttgttctgcattaaggccttttttgctttgacttgaaataagttctttgacagagcatattgcttggttaattaagtaacctaaagtatgcattaggattgtgaaatgtctcgtgagtatgccaatcctgagggtggaaccaaatagcctttgatgaaaagggcagtggattctggaggctctacttcaggtgctgctataatgcctcatctaatcaggactaaattgtgtaggaaactgcagtgggaagaatatgctttctgctcaggctaagagggtcactgatctgtccttagaaattcagagtaacatgagcaaaacctcagctaaaacccatttaagtggcatggattgtgcatgatctttgataagaattcctcatgtacttgtgcctagtttttcaaggtattggctgttctatagatgcagtgattgtcccagctagctctgttaccagccttttggtgtgtctttatgttcatttggagagtcagggcgaaagacaggtgatgtagcacttctgtttttaataattattgcttaaaatacctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattctcaggcatggtttggcagtgcaagaattctgtaacattaacaaattcaataaaaagtaaatatatggattttggactgtaaaaaaaaa

SEQ ID NO: 72353 - DNA, 2877 bp, Homo sapiens
ggcacgagctggctcgcgcgtgccttttcccctcaggttgtggggagagcggaatcctgctccgccgtcgcagcagcagcggcagccccggcagcctcgggcgacagcggcggcgcgcgagcccccgggcggaccgtaccaccgctcgccagcacgcagggggagccgcccgtctcgccgcgcacgcctcggcgaccccgcggggctgaggcgtcgccgcgcccggcagcgtgagcgcagagccggcctcgaccccgagctcggagccccgcgggccgcgcccgccgccggccccacccatccgggtcgaggaggccgaggccatggctgagacggaggagcggagcctggacaacttctttgccaagagggacaagaagaagaagaaggagcggagcaaccgggcggcgagtgccgcgggcgcagcgggcagcgccggcggaagcagtggagccgcgggtgcggcgggcggcggggcgggcgcggggacccggccgggtgacggcgggaccgccagcgcgggggctgcgggcccaggggccgccaccaaggctgtgacgaaggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaaatactgagccttcataagggttgactacctcagatttgctgcactcattgtggacttcatgtggatcacaacttctggataagaagattacaactattaagtgtcgatgtgaaccttgcaaccagctctactggattcttatcagaaatcctgcataaaaagtcagccatctgggttctgatctgctgtaaaagatgaagatttaagtgaccttaattaacctgtcctgtgccctacccttaaggaatactctctgtagtaggctgttgttatattagacttcctggaacacaccgctgaaaagaactgatgtgttcagatcatctgtgtagggctgtgatttgtaatttaaactaattgtattctgaggtaaccacaaaataaattcaaccaaactggggtccaccaagtgggggaaggggaagggagagaataatcttgggggtttttttttttggtaatttttttatttggatagtgcttttttgttttgtttttgttctgcattaaggccttttttgctttgacttgaaataagttctttgacagagcatattgcttggttaattaagtaacctaaagtatgcattaggattgtgaaatgtctcgtgagtatgccaatcctgagggtggaaccaaatagcctttgatgaaaagggcagtggattctggaggctctacttcaggtgctgctataatgcctcatctaatcaggactaaattgtgtaggaaactgcagtgggaagaatatgctttctgctcaggctaagagggtcactgatctgtccttagaaattcagagtaacatgagcaaaacctcagctaaaacccatttaagtggcatggattgtgcatgatctttgataagaattcctcatgtacttgtgcctagtttttcaaggtattggctgttctatagatgcagtgattgtcccagctagctctgttaccagccttttggtgtgtctttatgttcatttggagagtcagggcgaaagacaggtgatgtagcacttctgtttttaataattattgcttaaaatacctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattctcaggcatggtttggcagtgcaagaattctgtaacattaacaaattcaataaaaagtaaatatatggattttggactgtaaaaaaaaa

SEQ ID NO: 72354 - DNA, 1761 bp, Homo sapiens
accatagtttacttttttaggatttctcccccttttaatagaaatatttgatcctatactatattccagttatcatagccaaattttttttttcctacccagatcattcttgatcatcagcttccccaactagtaagtctgtgcatcattgggtgtttttttttaaattaattgtaaattatcccagctattagatagaagggataatttaaaataaattcaaccaaactggggtccaccaagtgggggaaggggaagggagagaataatcttgggggtttttttttttggtaatttttttatttggatagtgcttttttgttttgtttttgttctgcattaaggccttttttgctttgacttgaaataagttctttgacagagcatattgcttggttaattaagtaacctaaagtatgcattaggattgtgaaatgtctcgtgagtatgccaatcctgagggtggaaccaaatagcctttgatgaaaagggcagtggattctggaggctctacttcaggtgctgctataatgcctcatctaatcaggactaaattgtgtaggaaactgcagtgggaagaatatgctttctgctcaggctaagagggtcactgatctgtccttagaaattcagagtaacatgagcaaaacctcagctaaaacccatttaagtggcatggattgtgcatgatctttgataagaattcctcatgtacttgtgcctagtttttcaaggtattggctgttctatagatgcagtgattgtcccagctagctctgttaccagccttttggtgtgtctttatgttcatttggagagtcagggcgaaagacaggtgatgtagcacttctgtttttaataattattgcttaaaatacctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattctcaggcatggtttggcagtgcaagaattctgtaacattaacaaattcaataaaaagtaaatatatggattttggactgtaaaaaaaaa

SEQ ID NO: 72355 - DNA, 4144 bp, Homo sapiens
ggcacgagctggctcgcgcgtgccttttcccctcaggttgtggggagagcggaatcctgctccgccgtcgcagcagcagcggcagccccggcagcctcgggcgacagcggcggcgcgcgagcccccgggcggaccgtaccaccgctcgccagcacgcagggggagccgcccgtctcgccgcgcacgcctcggcgaccccgcggggctgaggcgtcgccgcgcccggcagcgtgagcgcagagccggcctcgaccccgagctcggagccccgcgggccgcgcccgccgccggccccacccatccgggtcgaggaggccgaggccatggctgagacggaggagcggagcctggacaacttctttgccaagagggacaagaagaagaagaaggagcggagcaaccgggcggcgagtgccgcgggcgcagcgggcagcgccggcggaagcagtggagccgcgggtgcggcgggcggcggggcgggcgcggggacccggccgggtgacggcgggaccgccagcgcgggggctgcgggcccaggggccgccaccaaggctgtgacgaaggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaacaggtacttaaaatgaatgctacctggaattaaatgactacatatggcacatctacatcttactttagggacatgaattttttaaaataaataaaatgggaagaaatgtaaatgacatcagatggaaatgtgtttttggggtggcttttagaataaatcccagccttttcaccactttgagagcacagctggcttgaatttaaacctccacgtggacttgctcctctgctctgtcttaaaaaatgtgtaagggaccttgggagggcagtgattcaccacactcgagtttctttacctgatctaatcagatccactcccacaaaatcgatgtgaggagaaatcattgactaatgagtagaatttacttgaatgagaaaattgttacccttgtgcataaagagagagatgtattatctattacttgctaaaagtaagagtcttaggaggaatgtcattacacagcttttaacagttttcttcaagtttgtcctgaaatagggtcacagttaatactgttcagtagaagataggaccctagagcttcaatacagcgttctgtgttttctgtttgaattgaagccttaaaatggtttgataaggattttctatatgcctccactcctacccctccccaggattcttctaaggggtggcttttttttaaattcaaggacgaatattttcaaaaaccctagtgaagaagaaatatttactgattacatttcttttcccttagggataaagaaatggagaagagctttgaagtagtaagacacaaaaatagaggtagggatgaggtttcaaaaaaccaggcccttaaacttcagctagacaaccaatatgctgtgcttgaaaatcagaaaagcagccactcacaatacaattaaggaatgggctttgctaacccttctgaggtaactagactgcagctaaccaccaccaacagccattcatcatctgatctctgctggatctacagacaccgatgcagaccactcgatttcatgaccggccctattgcactatggaagttaaagtgtcacgactgctctatgcatattggatttaggggaattttcattgttacataaatgtgtgaactagtttcaacagtgttctttcatatttactctgcaaatacaaaaaaccaaaacctgcagccagtggtcatttcaaaatctttttatgttcagatactgagccttcataagggttgactacctcagatttgctgcactcattgtggacttcatgtggatcacaacttctggataagaagattacaactattaagtgtcgatgtgaaccttgcaaccagctctactggattcttatcagaaatcctgcataaaaagtcagccatctgggttctgatctgctgtaaaagatgaagatttaagtgaccttaattaacctgtcctgtgccctacccttaaggaatactctctgtagtaggctgttgttatattagacttcctggaacacaccgctgaaaagaactgatgtgttcagatcatctgtgtagggctgtgatttgtaatttaaactaattgtattctgaggtaaccacaaaataaattcaaccaaactggggtccaccaagtgggggaaggggaagggagagaataatcttgggggtttttttttttggtaatttttttatttggatagtgcttttttgttttgtttttgttctgcattaaggccttttttgctttgacttgaaataagttctttgacagagcatattgcttggttaattaagtaacctaaagtatgcattaggattgtgaaatgtctcgtgagtatgccaatcctgagggtggaaccaaatagcctttgatgaaaagggcagtggattctggaggctctacttcaggtgctgctataatgcctcatctaatcaggactaaattgtgtaggaaactgcagtgggaagaatatgctttctgctcaggctaagagggtcactgatctgtccttagaaattcagagtaacatgagcaaaacctcagctaaaacccatttaagtggcatggattgtgcatgatctttgataagaattcctcatgtacttgtgcctagtttttcaaggtattggctgttctatagatgcagtgattgtcccagctagctctgttaccagccttttggtgtgtctttatgttcatttggagagtcagggcgaaagacaggtgatgtagcacttctgtttttaataattattgcttaaaatacctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgttgatctcaaggatggtggagggagaatccggacattaaattctacaagattttgggaaaagaggaaaaaaaatggggggggggcgaaagaataaattgggggggccaagaagaagggaaatgaaaagggaaggggcaaaaagggggggaaaggtggtgaagaaaaaaagg

SEQ ID NO: 72356 - DNA, 1459 bp, Homo sapiens
atctataggctccctgtagatagtagtagttgttttcctgctctaactgttctttggaaggagcagaggatgaatctgttgcatcgctgggggggtttacttcactaggaatgtactgaaagataacatctctcccaaacttcacgtagataaaggatttgtgaacatcttaatgactagcttcttacagcagtggattctggaggctctacttcaggtgctgctataatgcctcatctaatcaggactaaattgtgtaggaaactgcagtgggaagaatatgctttctgctcaggctaagagggtcactgatctgtccttagaaattcagagtaacatgagcaaaacctcagctaaaacccatttaagtggcatggattgtgcatgatctttgataagaattcctcatgtacttgtgcctagtttttcaaggtattggctgttctatagatgcagtgattgtcccagctagctctgttaccagccttttggtgtgtctttatgttcatttggagagtcagggcgaaagacaggtgatgtagcacttctgtttttaataattattgcttaaaatacctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattctcaggcatggtttggcagtgcaagaattctgtaacattaacaaattcaataaaaagtaaatatatggattttggactgtaaaaaaaaa

SEQ ID NO: 72357 - DNA, 3471 bp, Homo sapiens
  misc_feature (3455)..(3456): n is a, c, g, or t
ggcacgagctggctcgcgcgtgccttttcccctcaggttgtggggagagcggaatcctgctccgccgtcgcagcagcagcggcagccccggcagcctcgggcgacagcggcggcgcgcgagcccccgggcggaccgtaccaccgctcgccagcacgcagggggagccgcccgtctcgccgcgcacgcctcggcgaccccgcggggctgaggcgtcgccgcgcccggcagcgtgagcgcagagccggcctcgaccccgagctcggagccccgcgggccgcgcccgccgccggccccacccatccgggtcgaggaggccgaggccatggctgagacggaggagcggagcctggacaacttctttgccaagagggacaagaagaagaagaaggagcggagcaaccgggcggcgagtgccgcgggcgcagcgggcagcgccggcggaagcagtggagccgcgggtgcggcgggcggcggggcgggcgcggggacccggccgggtgacggcgggaccgccagcgcgggggctgcgggcccaggggccgccaccaaggctgtgacgaaggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaacaggtacttaaaatgaatgctacctggaattaaatgactacatatggcacatctacatcttactttagggacatgaattttttaaaataaataaaatgggaagaaatgtaaatgacatcagatggaaatgtgtttttggggtggcttttagaataaatcccagccttttcaccactttgagagcacagctggcttgaatttaaacctccacgtggacttgctcctctgctctgtcttaaaaaatgtgtaagggaccttgggagggcagtgattcaccacactcgagtttctttacctgatctaatcagatccactcccacaaaatcgatgtgaggagaaatcattgactaatgagtagaatttacttgaatgagaaaattgttacccttgtgcataaagagagagatgtattatctattacttgctaaaagtaagagtcttaggaggaatgtcattacacagcttttaacagttttcttcaagtttgtcctgaaatagggtcacagttaatactgttcagtagaagataggaccctagagcttcaatacagcgttctgtgttttctgtttgaattgaagccttaaaatggtttgataaggattttctatatgcctccactcctacccctccccaggattcttctaaggggtggcttttttttaaattcaaggacgaatattttcaaaaaccctagtgaagaagaaatatttactgattacatttcttttcccttagggataaagaaatggagaagagctttgaagtagtaagacacaaaaatagaggtagggatgaggtttcaaaaaaccaggcccttaaacttcagctagacaaccaatatgctgtgcttgaaaatcagaaaagcagccactcacaatacaattaaggaatgggctttgctaacccttctgaggtaactagactgcagctaaccaccaccaacagccattcatcatctgatctctgctggatctacagacaccgatgcagaccactcgatttcatgaccggccctattgcactatggaagttaaagtgtcacgactgctctatgcatattggatttaggggaattttcattgttacataaatgtgtgaactagtttcaacagtgttctttcatatttactctgcaaatacaaaaaaccaaaacctgcagccagtggtcatttcaaaatctttttatgttcagatactgagccttcataagggttgactacctcagatttgctgcactcattgtggacttcatgtggatcacaacttctggataagaagattacaactattaagtgtcgatgtgaaccttgcaaccagctctactggattcttatcagaaatcctgcataaaaagtcagccatctgggttctgatctgctgtaaaagatgaagatttaagtgaccttaattaacctgtcctgtgccctacccttaaggaatactctctgtagtaggctgttgttatattagacttcctggaacacaccgctgaaaagaactgatgtgttcagatcatctgtgtagggctgtgatttgtaatttaaactaattgtattctgaggtaaccacaaaataaattcaaccaaactggggtccaccaagtgggggaaggggaagggagagaataatcttgggggtttttttttttggtaatttttttatttggatagtgcttttttgttttgtttttgttctgcattaaggccttttttgctttgacttgaaataagttctttgacagagcatattgcttggttaattaagtaacctaaagtatgcattaggattgtgaaatgtctcgtgagtatgccaatcctgagggtggaaccaaatagcctttgatgaaaagggcagtggattctggaggctctacttcaggtgctgctataatgcctcatctaatcaggactaaattgtgtaggaaactgcagtgggaagaatatgctttctgctcaggctaagagggtcactgatctgtccttagaaattcagagtaacatgagcaaaacctcagctaaaacccatttaagtggcatggattgtgcatgatctttgataagaattcctcatgtacttgtgcctagtttttcaaggtattggctgttctatagatgcagtgattgtcccagctagctctgttaccagccttttggtgtgtctttatgttcatttggagagtcagggcgaaagacaggtgatgtagcacttctgtttttaataattattgcttaaaatacctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtggggtaggaggtnnggatactctaaagtc

SEQ ID NO: 72358 - DNA, 1114 bp, Homo sapiens
cgctctagaggatctcccctcctaccccatggattgtgcatgatctttgataagaattcctcatgtacttgtgcctagtttttcaaggtattggctgttctatagatgcagtgattgtcccagctagctctgttaccagccttttggtgtgtctttatgttcatttggagagtcagggcgaaagacaggtgatgtagcacttctgtttttaataattattgcttaaaatacctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattctcaggcatggtttggcagtgcaagaattctgtaacattaacaaattcaataaaaagtaaatatatggattttggactgtaaaaaaaaa

SEQ ID NO: 72359 - DNA, 1107 bp, Homo sapiens
gggaattcttatcaaagatcatgcacaagtacatgaggaattcttatcaaagatcatgtacttgtgcctagtttttcaaggtattggctgttctatagatgcagtgattgtcccagctagctctgttaccagccttttggtgtgtctttatgttcatttggagagtcagggcgaaagacaggtgatgtagcacttctgtttttaataattattgcttaaaatacctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattctcaggcatggtttggcagtgcaagaattctgtaacattaacaaattcaataaaaagtaaatatatggattttggactgtaaaaaaaaa

SEQ ID NO: 72360 - DNA, 923 bp, Homo sapiens
tccgacacgctccggaactagattactggcttacgactacctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattctcaggcatggtttggcagtgcaagaattctgtaacattaacaaattcaataaaaagtaaatatatggattttggactgtaaaaaaaaa

SEQ ID NO: 72361 - DNA, 919 bp, Homo sapiens
gttgattctagagtatcccggtcatcttgctacaccctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattctcaggcatggtttggcagtgcaagaattctgtaacattaacaaattcaataaaaagtaaatatatggattttggactgtaaaaaaaaa

SEQ ID NO: 72362 - DNA, 3182 bp, Homo sapiens
ggcacgagctggctcgcgcgtgccttttcccctcaggttgtggggagagcggaatcctgctccgccgtcgcagcagcagcggcagccccggcagcctcgggcgacagcggcggcgcgcgagcccccgggcggaccgtaccaccgctcgccagcacgcagggggagccgcccgtctcgccgcgcacgcctcggcgaccccgcggggctgaggcgtcgccgcgcccggcagcgtgagcgcagagccggcctcgaccccgagctcggagccccgcgggccgcgcccgccgccggccccacccatccgggtcgaggaggccgaggccatggctgagacggaggagcggagcctggacaacttctttgccaagagggacaagaagaagaagaaggagcggagcaaccgggcggcgagtgccgcgggcgcagcgggcagcgccggcggaagcagtggagccgcgggtgcggcgggcggcggggcgggcgcggggacccggccgggtgacggcgggaccgccagcgcgggggctgcgggcccaggggccgccaccaaggctgtgacgaaggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaacaggtacttaaaatgaatgctacctggaattaaatgactacatatggcacatctacatcttactttagggacatgaattttttaaaataaataaaatgggaagaaatgtaaatgacatcagatggaaatgtgtttttggggtggcttttagaataaatcccagccttttcaccactttgagagcacagctggcttgaatttaaacctccacgtggacttgctcctctgctctgtcttaaaaaatgtgtaagggaccttgggagggcagtgattcaccacactcgagtttctttacctgatctaatcagatccactcccacaaaatcgatgtgaggagaaatcattgactaatgagtagaatttacttgaatgagaaaattgttacccttgtgcataaagagagagatgtattatctattacttgctaaaagtaagagtcttaggaggaatgtcattacacagcttttaacagttttcttcaagtttgtcctgaaatagggtcacagttaatactgttcagtagaagataggaccctagagcttcaatacagcgttctgtgttttctgtttgaattgaagccttaaaatggtttgataaggattttctatatgcctccactcctacccctccccaggattcttctaaggggtggcttttttttaaattcaaggacgaatattttcaaaaaccctagtgaagaagaaatatttactgattacatttcttttcccttagggataaagaaatggagaagagctttgaagtagtaagacacaaaaatagaggtagggatgaggtttcaaaaaaccaggcccttaaacttcagctagacaaccaatatgctgtgcttgaaaatcagaaaagcagccactcacaatacaattaaggaatgggctttgctaacccttctgaggtaactagactgcagctaaccaccaccaacagccattcatcatctgatctctgctggatctacagacaccgatgcagaccactcgatttcatgaccggccctattgcactatggaagttaaagtgtcacgactgctctatgcatattggatttaggggaattttcattgttacataaatgtgtgaactagtttcaacagtgttctttcatatttactctgcaaatacaaaaaaccaaaacctgcagccagtggtcatttcaaaatctttttatgttcagatactgagccttcataagggttgactacctcagatttgctgcactcattgtggacttcatgtggatcacaacttctggataagaagattacaactattaagtgtcgatgtgaaccttgcaaccagctctactggattcttatcagaaatcctgcataaaaagtcagccatctgggttctgatctgctgtaaaagatgaagatttaagtgaccttaattaacctgtcctgtgccctacccttaaggaatactctctgtagtaggctgttgttatattagacttcctggaacacaccgctgaaaagaactgatgtgttcagatcatctgtgtagggctgtgatttgtaatttaaactaattgtattctgaggtaaccacaaaataaattcaaccaaactggggtccaccaagtgggggaaggggaagggagagaataatcttgggggtttttttttttggtaatttttttatttggatagtgcttttttgttttgtttttgttctgcattaaggccttttttgctttgacttgaaataagttctttgacagagcatattgcttggttaattaagtaacctaaagtatgcattaggattgtgaaatgtctcgtgagtatgccaatcctgagggtggaaccaaatagcctttgatgaaaagggcagtggattctggaggctctacttcaggtgctgctataatgcctcatctaatcaggactaaattgtgtaggaaactgcagtgggaagaatatgctttctgctcaggctaagagggtcactgatctgtccttagaaattcagagtaacatgagcaaaacctcacagatttaaattacaactcttgttataactttttaaaagattgtgaaaatatcaaaatataaatgaatcaagttttaatatactgtatgatgggtggatgaggctgtccattgtaccatttgtttgaattctcaggcatggtttggcagtgcaagaattctgtaacattaacaaattcaataaaaagtaaatatatggattttggactgtaaaaaaaaa

SEQ ID NO: 72363 - DNA, 576 bp, Homo sapiens
gtacccttccaacatctcatttctgatttaatcatcgacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattctcaggcatggtttggcagtgcaagaattctgtaacattaacaaattcaataaaaagtaaatatatggattttggactgtaaaaaaaaa

SEQ ID NO: 72364 - DNA, 2567 bp, Homo sapiens
ggcacgagctggctcgcgcgtgccttttcccctcaggttgtggggagagcggaatcctgctccgccgtcgcagcagcagcggcagccccggcagcctcgggcgacagcggcggcgcgcgagcccccgggcggaccgtaccaccgctcgccagcacgcagggggagccgcccgtctcgccgcgcacgcctcggcgaccccgcggggctgaggcgtcgccgcgcccggcagcgtgagcgcagagccggcctcgaccccgagctcggagccccgcgggccgcgcccgccgccggccccacccatccgggtcgaggaggccgaggccatggctgagacggaggagcggagcctggacaacttctttgccaagagggacaagaagaagaagaaggagcggagcaaccgggcggcgagtgccgcgggcgcagcgggcagcgccggcggaagcagtggagccgcgggtgcggcgggcggcggggcgggcgcggggacccggccgggtgacggcgggaccgccagcgcgggggctgcgggcccaggggccgccaccaaggctgtgacgaaggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaacaggtacttaaaatgaatgctacctggaattaaatgactacatatggcacatctacatcttactttagggacatgaattttttaaaataaataaaatgggaagaaatgtaaatgacatcagatggaaatgtgtttttggggtggcttttagaataaatcccagccttttcaccactttgagagcacagctggcttgaatttaaacctccacgtggacttgctcctctgctctgtcttaaaaaatgtgtaagggaccttgggagggcagtgattcaccacactcgagtttctttacctgatctaatcagatccactcccacaaaatcgatgtgaggagaaatcattgactaatgagtagaatttacttgaatgagaaaattgttacccttgtgcataaagagagagatgtattatctattacttgctaaaagtaagagtcttaggaggaatgtcattacacagcttttaacagttttcttcaagtttgtcctgaaatagggtcacagttaatactgttcagtagaagataggaccctagagcttcaatacagcgttctgtgttttctgtttgaattgaagccttaaaatggtttgataaggattttctatatgcctccactcctacccctccccaggattcttctaaggggtggcttttttttaaattcaaggacgaatattttcaaaaaccctagtgaagaagaaatatttactgattacatttcttttcccttagggataaagaaatggagaagagctttgaagtagtaagacacaaaaatagaggtagggatgaggtttcaaaaaaccaggcccttaaacttcagctagacaaccaatatgctgtgcttgaaaatcagaaaagcagccactcacaatacaattaaggaatgggctttgctaacccttctgaggtaactagactgcagctaaccaccaccaacagccattcatcatctgatctctgctggatctacagacaccgatgcagaccactcgatttcatgaccggccctattgcactatggaagttaaagtgtcacgactgctctatgcatattggatttaggggaattttcattgttacataaatgtgtgaactagtttcaacagtgttctttcatatttactctgcaaatacaaaaaaccaaaacctgcagccagtggtcatttcaaaatctttttatgttcagatactgagccttcataagggttgactacctcagatttgctgcactcattgtggacttcatgtggatcacaacttctggataagaagattacaactattaagtgtcgatgtgaaccttgcaaccagctctactggattcttatcagaaatcctgcataaaaagtcagccatctgggttctgatctgctgtaaaagatgaagatttaagtgaccttaattaacctgtcctgtgccctacccttaaggaatactagtatctgaacataaaaagattttgaaatgaccactgcctgcaggttttggttttttgtatttgcagagtaaatatgaaagaccactgttgaaactagttcacacatttatgtaacaatgaaaattcccctaaatccaatatgcatagagcagtcgtgacactttaacttccat

SEQ ID NO: 72365 - DNA, 2146 bp, Homo sapiens
ggcacgagctggctcgcgcgtgccttttcccctcaggttgtggggagagcggaatcctgctccgccgtcgcagcagcagcggcagccccggcagcctcgggcgacagcggcggcgcgcgagcccccgggcggaccgtaccaccgctcgccagcacgcagggggagccgcccgtctcgccgcgcacgcctcggcgaccccgcggggctgaggcgtcgccgcgcccggcagcgtgagcgcagagccggcctcgaccccgagctcggagccccgcgggccgcgcccgccgccggccccacccatccgggtcgaggaggccgaggccatggctgagacggaggagcggagcctggacaacttctttgccaagagggacaagaagaagaagaaggagcggagcaaccgggcggcgagtgccgcgggcgcagcgggcagcgccggcggaagcagtggagccgcgggtgcggcgggcggcggggcgggcgcggggacccggccgggtgacggcgggaccgccagcgcgggggctgcgggcccaggggccgccaccaaggctgtgacgaaggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaacaggtacttaaaatgaatgctacctggaattaaatgactacatatggcacatctacatcttactttagggacatgaattttttaaaataaataaaatgggaagaaatgtaaatgacatcagatggaaatgtgtttttggggtggcttttagaataaatcccagccttttcaccactttgagagcacagctggcttgaatttaaacctccacgtggacttgctcctctgctctgtcttaaaaaatgtgtaagggaccttgggagggcagtgattcaccacactcgagtttctttacctgatctaatcagatccactcccacaaaatcgatgtgaggagaaatcattgactaatgagtagaatttacttgaatgagaaaattgttacccttgtgcataaagagagagatgtattatctattacttgctaaaagtaagagtcttaggaggaatgtcattacacagcttttaacagttttcttcaagtttgtcctgaaatagggtcacagttaatactgttcagtagaagataggaccctagagcttcaatacagcgttctgtgttttctgtttgaattgaagccttaaaatggtttgataaggattttctatatgcctccactcctacccctccccaggattcttctaaggggtggcttttttttaaattcaaggacgaatattttcaaaaaccctagtgaagaagaaatatttactgattacatttcttttcccttagggataaagaaatggagaagagctttgaagtagtaagacacaaaaatagaggtagggatgaggtttcaaaaaaccaggcccttaaacttcagctagacaaccaatatgctgtgcttgaaaatcagaaaagcagccactcacaatacaattaaggaatgggctttgctaacccttctgaggtaactagactgcagctaaccaccaccaacagccattcatcatctgatctctgctggatctacagacaccgatgcagaccactcgatttcatgaccggccctattgcactatggaagttaaagtgtcacgactgctctatgcatattggatttaggggaattttcattgttacataaatgtgtgaactagtttcaacagtgttctttcatatttactctgcaaatacaaaaaaccaaaacctgcaaaaaaaaacccccacaaatatcctccaacaaaaaaaaa

SEQ ID NO: 72366 - DNA, 1002 bp, Homo sapiens
ggcacgagctggctcgcgcgtgccttttcccctcaggttgtggggagagcggaatcctgctccgccgtcgcagcagcagcggcagccccggcagcctcgggcgacagcggcggcgcgcgagcccccgggcggaccgtaccaccgctcgccagcacgcagggggagccgcccgtctcgccgcgcacgcctcggcgaccccgcggggctgaggcgtcgccgcgcccggcagcgtgagcgcagagccggcctcgaccccgagctcggagccccgcgggccgcgcccgccgccggccccacccatccgggtcgaggaggccgaggccatggctgagacggaggagcggagcctggacaacttctttgccaagagggacaagaagaagaagaaggagcggagcaaccgggcggcgagtgccgcgggcgcagcgggcagcgccggcggaagcagtggagccgcgggtgcggcgggcggcggggcgggcgcggggacccggccgggtgacggcgggaccgccagcgcgggggctgcgggcccaggggccgccaccaaggctgtgacgaaggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgttacagaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaacaggtacttaaaatgaatgctacctggctacctggtgttagtgtctacctggt

SEQ ID NO: 72367 - DNA, 890 bp, Homo sapiens
  misc_feature (813)..(813): n is a, c, g, or t
ggcacgagctggctcgcgcgtgccttttcccctcaggttgtggggagagcggaatcctgctccgccgtcgcagcagcagcggcagccccggcagcctcgggcgacagcggcggcgcgcgagcccccgggcggaccgtaccaccgctcgccagcacgcagggggagccgcccgtctcgccgcgcacgcctcggcgaccccgcggggctgaggcgtcgccgcgcccggcagcgtgagcgcagagccggcctcgaccccgagctcggagccccgcgggccgcgcccgccgccggccccacccatccgggtcgaggaggccgaggccatggctgagacggaggagcggagcctggacaacttctttgccaagagggacaagaagaagaagaaggagcggagcaaccgggcggcgagtgccgcgggcgcagcgggcagcgccggcggaagcagtggagccgcgggtgcggcgggcggcggggcgggcgcggggacccggccgggtgacggcgggaccgccagcgcgggggctgcgggcccaggggccgccaccaaggctgtgacgaaggacgaagatgaatggaaagaattggagcaaaaagaggttgattacagcggcctcagggttcaggcaatgcaaataagcagtgaaaaggaagaagacgataatgaaaagagacaagatccaggtgataactgggaagaaggtggaggtggtggtggaggtatggaaaaatcttcaggtccctggaataaaacagctccagtacaagcacctcctgctccagtaattgtacagaaccccagaccacgtgatngttgtgttataggctcttgggccagttaccacaccaagaacacccaaggccccagaatttcatgttcaattccctcc

SEQ ID NO: 72368 - DNA, 1336 bp, Homo sapiens
  misc_feature (30)..(30): n is a, c, g, or t
aaattacggctagtacgaggctggtttaantcggacgagggagctacccaggcttccctggagtcggccccacggatcatgcggctggtggccgaatgcagccgctccaggcccgggcaggcgagctgtggctgccgcatgggacagtggccactcctgtgttcatgccagtgggcacgcaggccaccatgaagggcatcacgaccgaacagctggacgctctgggttgccgcatctgcctgggcaatacctaccatctgggtctaaggccgggacccgagctgatccagaaagccaacggtctccacggcttcatgaattggcctcataatctgctaacggacagcggcggtttccagatggtgtcgctggtgtctctgtccgaggtgacggaggagggcgtccgcttccgctccccctacgacggcaatgagaccctgctgagcccggagaaatccgtgcagatccagaatgcgctgggctcggacatcatcatgcagctggacgacgtggttagcagtactgtgactgggccacgtgtggaggaggccatgtacaggtcaatccgctggctggaccggtgcattgcagcccatcagcggccggacaagcagaacctcttcgccattatccagggtgggctggacgcagatctccgggccacctgccttgaagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttggctatgccactgatctggtagtctgcgtggctcttggatgtgacatgttcgactgcgtcttccccacacggacagcgcgctttggctctgccctggtgcccactgggaacctgcagttgaggaagaaggtgtttgagaaggacttcggccccatagacccggagtgcacctgccccacgtgccaaaagcacagccgcgccttcctgcacgcactgctgcacagtgacaacacggccgcgctgcaccacctcacggtccacaacatcgcctaccagctgcagctcatgagcgccgtccgcaccagcatcgtggagaagcgcttcccggacttcgtgcgggacttcatgggcgccatgtacggggatcccaccctctgtcccacctgggccactgacgctctggcctctgtgggaatcacactgggctgacctggcattgggagagggagggaggaaggaagggagggaggggctggaagatactgaaggattcctttttgaaaggttttttttattgtaactta

SEQ ID NO: 72369 - DNA, 1382 bp, Homo sapiens
  misc_feature (400)..(401): n is a, c, g, or t
  misc_feature (409)..(409): n is a, c, g, or t
  misc_feature (411)..(411): n is a, c, g, or t
  misc_feature (421)..(421): n is a, c, g, or t
  misc_feature (433)..(434): n is a, c, g, or t
  misc_feature (449)..(449): n is a, c, g, or t
  misc_feature (451)..(452): n is a, c, g, or t
  misc_feature (454)..(454): n is a, c, g, or t
  misc_feature (456)..(456): n is a, c, g, or t
  misc_feature (463)..(463): n is a, c, g, or t
  misc_feature (479)..(479): n is a, c, g, or t
  misc_feature (491)..(491): n is a, c, g, or t
  misc_feature (494)..(494): n is a, c, g, or t
  misc_feature (506)..(506): n is a, c, g, or t
  misc_feature (508)..(508): n is a, c, g, or t
  misc_feature (512)..(512): n is a, c, g, or t
  misc_feature (520)..(520): n is a, c, g, or t
  misc_feature (527)..(527): n is a, c, g, or t
  misc_feature (529)..(529): n is a, c, g, or t
  misc_feature (542)..(542): n is a, c, g, or t
  misc_feature (546)..(546): n is a, c, g, or t
  misc_feature (553)..(554): n is a, c, g, or t
  misc_feature (557)..(557): n is a, c, g, or t
  misc_feature (559)..(559): n is a, c, g, or t
  misc_feature (565)..(565): n is a, c, g, or t
  misc_feature (577)..(577): n is a, c, g, or t
  misc_feature (581)..(581): n is a, c, g, or t
  misc_feature (595)..(595): n is a, c, g, or t
  misc_feature (599)..(600): n is a, c, g, or t
  misc_feature (602)..(602): n is a, c, g, or t
  misc_feature (616)..(616): n is a, c, g, or t
  misc_feature (618)..(619): n is a, c, g, or t
  misc_feature (634)..(634): n is a, c, g, or t
  misc_feature (639)..(640): n is a, c, g, or t
  misc_feature (646)..(646): n is a, c, g, or t
  misc_feature (662)..(662): n is a, c, g, or t
  misc_feature (672)..(672): n is a, c, g, or t
  misc_feature (674)..(674): n is a, c, g, or t
  misc_feature (678)..(680): n is a, c, g, or t
  misc_feature (704)..(705): n is a, c, g, or t
  misc_feature (708)..(714): n is a, c, g, or t
  misc_feature (718)..(719): n is a, c, g, or t
  misc_feature (721)..(721): n is a, c, g, or t
ccttgacctcatgtaatttgcattgtagcaaggaaggcagacttgaggcgaggagcagatgacagagagcagtaacagctctgaagaaaagctagaggctgatgagatgaccatgacttggggtgaggggagagagcaagacaaggactgctctgtcgggaaggcctttgactgggggcctgaatgatggagagccagccacatgaaaaacttaaaaacagcactgcaaaaagagcactgcaggcaaggaattggtaaatgcaaaggccctggggcatgttgaagggtggaaggaaggccagtggagctggagccaagagatggaggggcagcttggtgggtgaagagccccagggacccgcagtgtcatcacctaggagcttcttagaaatgcagactnnggccgggngnggtggctcangcctgtaatccnngcactttgggaggcngnngngngcggatnacctgaggtcaggagntcaagaccagcntgnccaacatggcgnancccngtctctantaaaaananaaaaaattagccnggcntggtggnnggngnctgtantcccagctactngggnggctgaggcagganaatnncntgaacccgggaggngnnggttgcagtgagccnagatnntgccantgcactccagcctggntgacagagcnanactnnntctcaaaaaaaaaaaaaaaaaaannaannnnnnngatnnanagatgaccaagcgagacgtgcctggcttcgccatcgggggcctgagcgggggtgagagcaagtcgcagttctggcggatggtggcgctgagcacctctcggctgccgaaggacaagccccgatatctgatgggggttggctatgccactgatctggtagtctgcgtggctcttggatgtgacatgttcgactgcgtcttccccacacggacagcgcgctttggctctgccctggtgcccactgggaacctgcagttgaggaagaaggtgtttgagaaggacttcggccccatagacccggagtgcacctgccccacgtgccaaaagcacagccgcgccttcctgcacgcactgctgcacagtgacaacacggccgcgctgcaccacctcacggtccacaacatcgcctaccagctgcagctcatgagcgccgtccgcaccagcatcgtggagaagcgcttcccggacttcgtgcgggacttcatgggcgccatgtacggggatcccaccctctgtcccacctgggccactgacgctctggcctctgtgggaatcacactgggctgacctggcattgggagagggagggaggaaggaagggagggaggggctggaagatactgaaggattcctttttgaaaggttttttttattgtaactta

SEQ ID NO: 72370 - DNA, 389 bp, Homo sapiens
gactctacaggatcttctgtgctttgggacggcgctgcgtttggttacggcgttgctgggggaaaacagaatgggtacttgagtctgaagctttagtggccaggccacagtggcggggagggggtgtcaggccctggacccatgcccaggacagaaaagcaggagcagaacactatcccaagaaagaccctacggaggacctctggaggcgcagggtgcagcaggaagttacaccccgccgtcccaaagcacagcctgcccccacgtgccaaaagcacagccgcgccttcctgcacgcactgctgcacagtgacaacacggccgcgctgcaccacctcacggtccacaacatcgcctaccaggtgagccagtgcccggggcaaggtggg

SEQ ID NO: 72371 - DNA, 1327 bp, Homo sapiens
cacgtggttccgacagtcaagatggcgggagcagctacccaggcttccctggagtcggccccacggatcatgcggctggtggccgaatgcagccgctccaggcccgggcaggcgagctgtggctgccgcatgggacagtggccactcctgtgttcatgccagtgggcacgcaggccaccatgaagggcatcacgaccgaacagctggacgctctgggttgccgcatctgcctgggcaatacctaccatctgggtctaaggccgggacccgagctgatccagaaagccaacggtctccacggcttcatgaattggcctcataatctgctaacggacagcggcggtttccagatggtgtcgctggtgtctctgtccgaggtgacggaggagggcgtccgcttccgctccccctacgacggcaatgagaccctgctgagcccggagaaatccgtgcagatccagaatgcgctgggctcggacatcatcatgcagctggacgacgtggttagcagtactgtgactgggccacgtgtggaggaggccatgtacaggtcaatccgctggctggaccggtgcattgcagcccatcagcggccggacaagcagaacctcttcgccattatccagggtgggctggacgcagatctccgggccacctgccttgaagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttggctatgccactgatctggtagtctgcgtggctcttggatgtgacatgttcgactgcgtcttccccacacggacagcgcgctttggctctgccctggtgcccactgggaacctgcagttgaggaagaaggtgtttgagaaggacttcggccccatagacccggagtgcacctgccccacgtgccaaaagcacagccgcgccttcctgcacgcactgctgcacagtgacaacacggccgcgctgcaccacctcacggtccacaacatcgcctaccagctgcagctcatgagcgccgtccgcaccagcatcgtggagaagcgcttcccggacttcgtgcgggacttcatgggcgccatgtacggggatcccaccctctgtcccacctgggccactgacgctctggcctctgtgggaatcacactgggctgacctggcattgggagagggagggaggaaggaagggagggaggggctggaagatactgaaggattcctttttgaaaggttttttttattgtaactta

SEQ ID NO: 72372 - DNA, 1325 bp, Homo sapiens
caggctgtactggtctggatgtttgggatgagctacccaggcttccctggagtcggccccacggatcatgcggctggtggccgaatgcagccgctccaggcccgggcaggcgagctgtggctgccgcatgggacagtggccactcctgtgttcatgccagtgggcacgcaggccaccatgaagggcatcacgaccgaacagctggacgctctgggttgccgcatctgcctgggcaatacctaccatctgggtctaaggccgggacccgagctgatccagaaagccaacggtctccacggcttcatgaattggcctcataatctgctaacggacagcggcggtttccagatggtgtcgctggtgtctctgtccgaggtgacggaggagggcgtccgcttccgctccccctacgacggcaatgagaccctgctgagcccggagaaatccgtgcagatccagaatgcgctgggctcggacatcatcatgcagctggacgacgtggttagcagtactgtgactgggccacgtgtggaggaggccatgtacaggtcaatccgctggctggaccggtgcattgcagcccatcagcggccggacaagcagaacctcttcgccattatccagggtgggctggacgcagatctccgggccacctgccttgaagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttggctatgccactgatctggtagtctgcgtggctcttggatgtgacatgttcgactgcgtcttccccacacggacagcgcgctttggctctgccctggtgcccactgggaacctgcagttgaggaagaaggtgtttgagaaggacttcggccccatagacccggagtgcacctgccccacgtgccaaaagcacagccgcgccttcctgcacgcactgctgcacagtgacaacacggccgcgctgcaccacctcacggtccacaacatcgcctaccagctgcagctcatgagcgccgtccgcaccagcatcgtggagaagcgcttcccggacttcgtgcgggacttcatgggcgccatgtacggggatcccaccctctgtcccacctgggccactgacgctctggcctctgtgggaatcacactgggctgacctggcattgggagagggagggaggaaggaagggagggaggggctggaagatactgaaggattcctttttgaaaggttttttttattgtaactta

SEQ ID NO: 72373 - DNA, 1580 bp, Homo sapiens
cacgtggttccgacagtcaagatggcgggagcagctacccaggcttccctggagtcggccccacggatcatgcggctggtggccgaatgcagccgctccaggcccgggcaggcgagctgtggctgccgcatgggacagtggccactcctgtgttcatgccagtgggcacgcaggccaccatgaagggcatcacgaccgaacagctggacgctctgggttgccgcatctgcctgggcaatacctaccatctgggtctaaggccgggacccgagctgatccagaaagccaacggtctccacggcttcatgaattggcctcataatctgctaacggacagcggcggtttccagatggtgtcgctggtgtctctgtccgaggtgacggaggagggcgtccgcttccgctccccctacgacggcaatgagaccctgctgagcccggagaaatccgtgcagatccagaatgcgctgggctcggacatcatcatgcagctggacgacgtggttagcagtactgtgactgggccacgtgtggaggaggccatgtacaggtcaatccgctggctggaccggtgcattgcagcccatcagcggccggacaagcagaacctcttcgccattatccagggtgggctggacgcagatctccgggccacctgccttgaagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttgggtatgttgtggatagggaagccagagccctacctgtgggaagtggattcctggggaccccctaccctgcttggggaggtggcatttgggggaaacggacacaggtctgatctgaggagactaggaagacatggctgtcccttgggggccattctgagggaatatggcccagtctggggcagtgtgagggttgggaggggccctgggaagcccctgaggttctctgccccctcccgtcatggctgcaaccccagctatgccactgatctggtagtctgcgtggctcttggatgtgacatgttcgactgcgtcttccccacacggacagcgcgctttggctctgccctggtgcccactgggaacctgcagttgaggaagaaggtgtttgagaaggacttcggccccatagacccggagtgcacctgccccacgtgccaaaagcacagccgcgccttcctgcacgcactgctgcacagtgacaacacggccgcgctgcaccacctcacggtccacaacatcgcctaccagctgcagctcatgagcgccgtccgcaccagcatcgtggagaagcgcttcccggacttcgtgcgggacttcatgggcgccatgtacggggatcccaccctctgtcccacctgggccactgacgctctggcctctgtgggaatcacactgggctgacctggcattgggagagggagggaggaaggaagggagggaggggctggaagatactgaaggattcctttttgaaaggttttttttattgtaactta

SEQ ID NO: 72374 - DNA, 1712 bp, Homo sapiens
cacgtggttccgacagtcaagatggcgggagcagctacccaggcttccctggagtcggccccacggatcatgcggctggtggccgaatgcagccgctccaggcccgggcaggcgagctgtggctgccgcatgggacagtggccactcctgtgttcatgccagtgggcacgcaggccaccatgaagggcatcacgaccgaacagctggacgctctgggttgccgcatctgcctgggcaatacctaccatctgggtctaaggccgggacccgagctgatccagaaagccaacggtctccacggcttcatgaattggcctcataatctgctaacggacagcggcggtttccagatggtgtcgctggtgtctctgtccgaggtgacggaggagggcgtccgcttccgctccccctacgacggcaatgagaccctgctgagcccggagaaatccgtgcagatccagaatgcgctgggctcggacatcatcatgcagctggacgacgtggttagcagtactgtgactgggccacgtgtggaggaggccatgtacaggtcaatccgctggctggaccggtgcattgcagcccatcagcggccggacaagcagaacctcttcgccattatccagggtgggctggacgcagatctccgggccacctgccttgaagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttgggtatgttgtggatagggaagccagagccctacctgtgggaagtggattcctggggaccccctaccctgcttggggaggtggcatttgggggaaacggacacaggtctgatctgaggagactaggaagacatggctgtcccttgggggccattctgagggaatatggcccagtctggggcagtgtgagggttgggaggggccctgggaagcccctgaggttctctgccccctcccgtcatggctgcaaccccagctatgccactgatctggtagtctgcgtggctcttggatgtgacatgttcgactgcgtcttccccacacggacagcggcggtgaggctctggcagaaggaggtcagggcgggagacgggtgggggactagggaggcaaggttaggggtggggggtggggagaatgaagccctgggtgacgcccctttccctgcccttcctctcccacagcgctttggctctgccctggtgcccactgggaacctgcagttgaggaagaaggtgtttgagaaggacttcggccccatagacccggagtgcacctgccccacgtgccaaaagcacagccgcgccttcctgcacgcactgctgcacagtgacaacacggccgcgctgcaccacctcacggtccacaacatcgcctaccagctgcagctcatgagcgccgtccgcaccagcatcgtggagaagcgcttcccggacttcgtgcgggacttcatgggcgccatgtacggggatcccaccctctgtcccacctgggccactgacgctctggcctctgtgggaatcacactgggctgacctggcattgggagagggagggaggaaggaagggagggaggggctggaagatactgaaggattcctttttgaaaggttttttttattgtaactta

SEQ ID NO: 72375 - DNA, 1251 bp, Homo sapiens
cacgtggttccgacagtcaagatggcgggagcagctacccaggcttccctggagtcggccccacggatcatgcggctggtggccgaatgcagccgctccaggcccgggcaggcgagctgtggctgccgcatgggacagtggccactcctgtgttcatgccagtgggcacgcaggccaccatgaagggcatcacgaccgaacagctggacgctctgggttgccgcatctgcctgggcaatacctaccatctgggtctaaggccgggacccgagctgatccagaaagccaacggtctccacggcttcatgaattggcctcataatctgctaacggacagcggcggtttccagatggtgtcgctggtgtctctgtccgaggtgacggaggagggcgtccgcttccgctccccctacgacggcaatgagaccctgctgagcccggagaaatccgtgcagatccagaatgcgctgggctcggacatcatcatgcagctggacgacgtggttagcagtactgtgactgggccacgtgtggaggaggccatgtacaggtcaatccgctggctggaccggtgcattgcagcccatcagcggccggacaagcagaacctcttcgccattatccagggtgggctggacgcagatctccgggccacctgccttgaagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttggcgctttggctctgccctggtgcccactgggaacctgcagttgaggaagaaggtgtttgagaaggacttcggccccatagacccggagtgcacctgccccacgtgccaaaagcacagccgcgccttcctgcacgcactgctgcacagtgacaacacggccgcgctgcaccacctcacggtccacaacatcgcctaccagctgcagctcatgagcgccgtccgcaccagcatcgtggagaagcgcttcccggacttcgtgcgggacttcatgggcgccatgtacggggatcccaccctctgtcccacctgggccactgacgctctggcctctgtgggaatcacactgggctgacctggcattgggagagggagggaggaaggaagggagggaggggctggaagatactgaaggattcctttttgaaaggttttttttattgtaactta

SEQ ID NO: 72376 - DNA, 1183 bp, Homo sapiens
cacgtggttccgacagtcaagatggcgggagcagctacccaggcttccctggagtcggccccacggatcatgcggctggtggccgaatgcagccgctccaggcccgggcaggcgagctgtggctgccgcatgggacagtggccactcctgtgttcatgccagtgggcacgcaggccaccatgaagggcatcacgaccgaacagctggacgctctgggttgccgcatctgcctgggcaatacctaccatctgggtctaaggccgggacccgagctgatccagaaagccaacggtctccacggcttcatgaattggcctcataatctgctaacggacagcggcggtttccagatggtgtcgctggtgtctctgtccgaggtgacggaggagggcgtccgcttccgctccccctacgacggcaatgagaccctgctgagcccggagaaatccgtgcagatccagaatgcgctgggctcggacatcatcatgcagctggacgacgtggttagcagtactgtgactgggccacgtgtggaggaggccatgtacaggtcaatccgctggctggaccggtgcattgcagcccatcagcggccggacaagcagaacctcttcgccattatccagggtgggctggacgcagatctccgggccacctgccttgaagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttggctatgccactgatctggtagtctgcgtggctcttggatgtgacatgttcgactgcgtcttccccacacggacagcgagtgacaacacggccgcgctgcaccacctcacggtccacaacatcgcctaccagctgcagctcatgagcgccgtccgcaccagcatcgtggagaagcgcttcccggacttcgtgcgggacttcatgggcgccatgtacggggatcccaccctctgtcccacctgggccactgacgctctggcctctgtgggaatcacactgggctgacctggcattgggagagggagggaggaaggaagggagggaggggctggaagatactgaaggattcctttttgaaaggttttttttattgtaactta

SEQ ID NO: 72377 - DNA, 1411 bp, Homo sapiens
cacgtggttccgacagtcaagatggcgggagcagctacccaggcttccctggagtcggccccacggatcatgcggctggtggccgaatgcagccgctccaggcccgggcaggcgagctgtggctgccgcatgggacagtggccactcctgtgttcatgccagtgggcacgcaggccaccatgaagggcatcacgaccgaacagctggacgctctgggttgccgcatctgcctgggcaatacctaccatctgggtctaaggccgggacccgagctgatccagaaagccaacggtctccacggcttcatgaattggcctcataatctgctaacggacagcggcggtttccagatggtgtcgctggtgtctctgtccgaggtgacggaggagggcgtccgcttccgctccccctacgacggcaatgagaccctgctgagcccggagaaatccgtgcagatccagaatgcgctgggctcggacatcatcatgcagctggacgacgtggttagcagtactgtgactgggccacgtgtggaggaggccatgtacaggtcaatccgctggctggaccggtgcattgcagcccatcagcggccggacaagcagaacctcttcgccattatccagggtgggctggacgcagatctccgggccacctgccttgaaggtcctcagagcgaaagtctaaaatccagaacattggccgggtaccatagctcacacctgaatcccagcactttaggaggccaagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttggctatgccactgatctggtagtctgcgtggctcttggatgtgacatgttcgactgcgtcttccccacacggacagcgcgctttggctctgccctggtgcccactgggaacctgcagttgaggaagaaggtgtttgagaaggacttcggccccatagacccggagtgcacctgccccacgtgccaaaagcacagccgcgccttcctgcacgcactgctgcacagtgacaacacggccgcgctgcaccacctcacggtccacaacatcgcctaccagctgcagctcatgagcgccgtccgcaccagcatcgtggagaagcgcttcccggacttcgtgcgggacttcatgggcgccatgtacggggatcccaccctctgtcccacctgggccactgacgctctggcctctgtgggaatcacactgggctgacctggcattgggagagggagggaggaaggaagggagggaggggctggaagatactgaaggattcctttttgaaaggttttttttattgtaactta

SEQ ID NO: 72378 - DNA, 1282 bp, Homo sapiens
cacgtggttccgacagtcaagatggcgggagcagctacccaggcttccctggagtcggccccacggatcatgcggctggtggccgaatgcagccgctccaggcccgggcaggcgagctgtggctgccgcatgggacagtggccactcctgtgttcatgccagtgggcacgcaggccaccatgaagggcatcacgaccgaacagctggacgctctgggttgccgcatctgcctgggcaatacctaccatctgggtctaaggccgggacccgagctgatccagaaagccaacggtctccacggcttcatgaattggcctcataatctgctaacggtgacggaggagggcgtccgcttccgctccccctacgacggcaatgagaccctgctgagcccggagaaatccgtgcagatccagaatgcgctgggctcggacatcatcatgcagctggacgacgtggttagcagtactgtgactgggccacgtgtggaggaggccatgtacaggtcaatccgctggctggaccggtgcattgcagcccatcagcggccggacaagcagaacctcttcgccattatccagggtgggctggacgcagatctccgggccacctgccttgaagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttggctatgccactgatctggtagtctgcgtggctcttggatgtgacatgttcgactgcgtcttccccacacggacagcgcgctttggctctgccctggtgcccactgggaacctgcagttgaggaagaaggtgtttgagaaggacttcggccccatagacccggagtgcacctgccccacgtgccaaaagcacagccgcgccttcctgcacgcactgctgcacagtgacaacacggccgcgctgcaccacctcacggtccacaacatcgcctaccagctgcagctcatgagcgccgtccgcaccagcatcgtggagaagcgcttcccggacttcgtgcgggacttcatgggcgccatgtacggggatcccaccctctgtcccacctgggccactgacgctctggcctctgtgggaatcacactgggctgacctggcattgggagagggagggaggaaggaagggagggaggggctggaagatactgaaggattcctttttgaaaggttttttttattgtaactta

SEQ ID NO: 72379 - DNA, 1573 bp, Homo sapiens
cacgtggttccgacagtcaagatggcgggagcagctacccaggcttccctggagtcggccccacggatcatgcggctggtggccgaatgcagccgctccaggcccgggcaggcgagctgtggctgccgcatgggacagtggccactcctgtgttcatgccagtgggcacgcaggccaccatgaagggcatcacgaccgaacagctggacgctctgggttgccgcatctgcctgggcaatacctaccatctgggtctaaggccggtgggtgggctctgcccgcgcggggaggcggcgaggcggcgaggcgtggggagccatggagcgtcctccaggcccggacactcctcccaaagtcaatcgaccagctgtattgagcgcccccaatgaccaggccttgtactgggcgtgaaagagcagcagggactaaagctggccagatctgtctcccaagaagggcccccagggacgcggtcacccctaacctgacactttcttccatcaacccagggacccgagctgatccagaaagccaacggtctccacggcttcatgaattggcctcataatctgctaacggacagcggcggtttccagatggtgtcgctggtgtctctgtccgaggtgacggaggagggcgtccgcttccgctccccctacgacggcaatgagaccctgctgagcccggagaaatccgtgcagatccagaatgcgctgggctcggacatcatcatgcagctggacgacgtggttagcagtactgtgactgggccacgtgtggaggaggccatgtacaggtcaatccgctggctggaccggtgcattgcagcccatcagcggccggacaagcagaacctcttcgccattatccagggtgggctggacgcagatctccgggccacctgccttgaagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttggctatgccactgatctggtagtctgcgtggctcttggatgtgacatgttcgactgcgtcttccccacacggacagcgcgctttggctctgccctggtgcccactgggaacctgcagttgaggaagaaggtgtttgagaaggacttcggccccatagacccggagtgcacctgccccacgtgccaaaagcacagccgcgccttcctgcacgcactgctgcacagtgacaacacggccgcgctgcaccacctcacggtccacaacatcgcctaccagctgcagctcatgagcgccgtccgcaccagcatcgtggagaagcgcttcccggacttcgtgcgggacttcatgggcgccatgtacggggatcccaccctctgtcccacctgggccactgacgctctggcctctgtgggaatcacactgggctgacctggcattgggagagggagggaggaaggaagggagggaggggctggaagatactgaaggattcctttttgaaaggttttttttattgtaactta

SEQ ID NO: 72380 - DNA, 1305 bp, Homo sapiens
ccaggctacctcgtgtgattcggcgccatgcattcatgcggttggtgatccgcattgcaaccgggtccgagtgtgccgggcaggtgctgaaactgtggctgtacgattgctacattgttcgactcctgtgttcatgccagtgggcacgcaggccaccatgaagggcatcacgaccgaacagctggacgctctgggttgccgcatctgcctgggcaatacctaccatctgggtctaaggccgggacccgagctgatccagaaagccaacggtctccacggcttcatgaattggcctcataatctgctaacggacagcggcggtttccagatggtgtcgctggtgtctctgtccgaggtgacggaggagggcgtccgcttccgctccccctacgacggcaatgagaccctgctgagcccggagaaatccgtgcagatccagaatgcgctgggctcggacatcatcatgcagctggacgacgtggttagcagtactgtgactgggccacgtgtggaggaggccatgtacaggtcaatccgctggctggaccggtgcattgcagcccatcagcggccggacaagcagaacctcttcgccattatccagggtgggctggacgcagatctccgggccacctgccttgaagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttggctatgccactgatctggtagtctgcgtggctcttggatgtgacatgttcgactgcgtcttccccacacggacagcgcgctttggctctgccctggtgcccactgggaacctgcagttgaggaagaaggtgtttgagaaggacttcggccccatagacccggagtgcacctgccccacgtgccaaaagcacagccgcgccttcctgcacgcactgctgcacagtgacaacacggccgcgctgcaccacctcacggtccacaacatcgcctaccagctgcagctcatgagcgccgtccgcaccagcatcgtggagaagcgcttcccggacttcgtgcgggacttcatgggcgccatgtacggggatcccaccctctgtcccacctgggccactgacgctctggcctctgtgggaatcacactgggctgacctggcattgggagagggagggaggaaggaagggagggaggggctggaagatactgaaggattcctttttgaaaggttttttttattgtaactta

SEQ ID NO: 72381 - DNA, 991 bp, Homo sapiens
aagttgaaatcatcgcagaaggataaagttcgtcagtttatgatcttcacacaatctagtgaaaaaacagcagacagcggcggtttccagatggtgtcgctggtgtctctgtccgaggtgacggaggagggcgtccgcttccgctccccctacgacggcaatgagaccctgctgagcccggagaaatccgtgcagatccagaatgcgctgggctcggacatcatcatgcagctggacgacgtggttagcagtactgtgactgggccacgtgtggaggaggccatgtacaggtcaatccgctggctggaccggtgcattgcagcccatcagcggccggacaagcagaacctcttcgccattatccagggtgggctggacgcagatctccgggccacctgccttgaagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttggcgctttggctctgccctggtgcccactgggaacctgcagttgaggaagaaggtgtttgagaaggacttcggccccatagacccggagtgcacctgccccacgtgccaaaagcacagccgcgccttcctgcacgcactgctgcacagtgacaacacggccgcgctgcaccacctcacggtccacaacatcgcctaccagctgcagctcatgagcgccgtccgcaccagcatcgtggagaagcgcttcccggacttcgtgcgggacttcatgggcgccatgtacggggatcccaccctctgtcccacctgggccactgacgctctggcctctgtgggaatcacactgggctgacctggcattgggagagggagggaggaaggaagggagggaggggctggaagatactgaaggattcctttttgaaaggttttttttattgtaactta

SEQ ID NO: 72382 - DNA, 407 bp, Homo sapiens
cacgtggttccgacagtcaagatggcgggagcagctacccaggcttccctggagtcggccccacggatcatgcggctggtggccgaatgcagccgctccaggcccgggcaggcgagctgtggctgccgcatgggacagtggccactcctgtgttcatgccagtgggcacgcaggccaccatgaagggcatcacgaccgaacagctggacgctctgggttgccgcatctgcctgggcaatacctaccatctgggtctaaggccgggacccgagctgatccagaaagccaacggtctccacggcttcatgaattggcctcataatctgctaacggtgagctgaggagagagccgacgttctagggcccttctctggagtgaagggtccccatctccaccccctgacagc

SEQ ID NO: 72383 - DNA, 371 bp, Homo sapiens
ctggccgtgctgagctgtcccctgccgctctacaggcacagccgcgccttcctgcacgcactgctgcacagtgacaacacggccgcgctgcaccacctcacggtccacaacatcgcctaccagctgcagctcatgagcgccgtccgcaccagcatcgtggagaagcgcttcccggacttcgtgcgggacttcatgggcgccatgtacggggatcccaccctctgtcccacctgggccactgacgctctggcctctgtgggaatcacactgggctgacctggcattgggagagggagggaggaaggaagggagggaggggctggaagatactgaaggattcctttttgaaaggttttttttattgtaactta

SEQ ID NO: 72384 - DNA, 349 bp, Homo sapiens
gcacatctgttcccaaaaggctttaacattctatagtctctaggaaattttatttttttcttcaaaatttcttgaataaattttatagaaatatgtatgcttttttatgcaccaaattaaaatgaagatttcgtaagatctaatttagcaaactttttaatgtctttcccttatttcttcaatattaagtgctgcaaaatgagcaagacagtttctcccttggaggagtgttcagctttaatagaagatagcacagggtcatatgtaactataatataaaactggataaggcccataaaagaattgcagataaactatgggagctcaaaaaagattatacccagtttag

SEQ ID NO: 72385 - DNA, 285 bp, Homo sapiens
ttctattccactttctgttttattttcatagatataaaaatatagtaattatgcatgtcacataaataagtggatgggaatggaagtcattttgttatattgtacaacaatgctcctatttgaactccttccgatttgccaaaatttacaggctgataatataccaaaaatatttcaatgacttatcagttggcaattcaatcacgtcttcatttaattttgttgtaaacaaagaattgaaaaccacctgatttgcagagagatttgttacccagtcatttccag

SEQ ID NO: 72386 - DNA, 275 bp, Homo sapiens
ctacctcaccccctccatccctctgcttctcagtgtaggatatagactcaggggtgggagatcaggggtgaaagccactatgaatactgagtcggctaaacagagttgctaaattggcctgggaatctgctgagggtccatcctcttgattctatgggaaaatgcagtttaaagatctaaagagctgggaggtccttacaagaggcttccttctgtgggcagcattggggtggggtggtgaggttaccccgcgggtgtctccctgccccagtgga

SEQ ID NO: 72387 - DNA, 2812 bp, Homo sapiens
  misc_feature (13)..(13): n is a, c, g, or t
  misc_feature (25)..(25): n is a, c, g, or t
gtttgcgcggggnaccacccgctcncccccccaaccctcctcagcagaagcagccggcggcgggggcaggagtcagcccgcttccgaccgtaccccgcccgcctcccggggctcctgttctttggccccgggaccctaaccttctcccggggcggttccctccgtctgggcgtccgagcgctgcccacatctttcattcctccctgcacctccttcccttcacttttgccccggctctctttctcctctctgtcctgctgtcgcctcctctcctcactccagcctccttccctggcttattctgcccaggaaagtttggaacccccgccccccctccccaatcaggtcaacctgactaggagtagggggagatgtaggaaggcctgagagttcggggggggggaagctggaagctggtttcccagaaaatttccccccatcttctccatttagggtggtgggaattttttttaatcctgtttttgaggaggtggtaggtgtttagaaaaggatgtgggaatggaaggggtagatgagtcaaccctctttcaagattccaagggtggtgtgttacctgatccttttcgtgtgtggagttcagggggtcgggaggtttggcctttattcccacattcaaagttggaacctcccccaaattaagaatggagttttagtacccacttgtggcaggaatcctggggggaaggggtccttttttcctttttcttttcttttttcccttttttttccttttggcaacccacacccttccacacacgctcaccccaaaattaaacaccaagatcctctaacttgtttggattgactgatgaagacataaagctctatgttttttgaggtggagtgagtggtttttcttcatttttaaatggccaaatgacagcttgacccagtttgctttccaatcaaagggcatttattttgaatgtctctttgtggcgcaagagccaacgcaaaaatgatggcggcttacaatggcggtacatctgcagcagcagcaggtcaccaccaccaccatcaccaccaccttccacacctccctcctcctcacctgcaccaccaccaccaccctcaacaccatcttcatccggggtcggctgccgctgtacaccctgtacagcagcacacctcttcggcagctgcggcagccgcagcagcggctgcagctgcagccatgttaaaccctgggcaacaacagccatatttcccatcaccggcaccggggcaggctcctggaccagctgcagcagccccagctcaggtacaggctgccgcagctgctacagttaaggcgcaccatcatcagcactcgcatcatccacagcagcagctggatattgagccggatagacctattggatatggagcctttggtgttgtctggtcagtaacagatccaagagatggaaagagagtagcgctcaaaaagatgcccaacgtcttccagaatctggtctcttgcaaaagggtcttccgggaattgaagatgttgtgtttttttaagcatgataatgtactctctgcccttgacatactccaacctccacacattgactattttgaagaaatatatgttgtcacagaattgatgcagagtgacctacataaaattatcgtctctcctcaaccactcagctcagatcatgtcaaagtttttctttatcagattttgcgaggtttgaaatatctccattcagctggcattttacatcgagacattaagccagggaatctccttgtgaacagcaactgtgttctaaagatttgtgattttggattggccagagtggaagaattagatgaatcccgtcatatgactcaggaagttgttactcagtattatcgggctccagaaatcctgatgggcagccgtcattacagcaatgctattgacatctggtctgtgggatgtatctttgcagaactactaggacgaagaatattgtttcaggcacagagtcccattcagcagttggatttgatcacggatctgttgggcacaccatcactggaagcaatgaggacagcttgtgaaggcgctaaggcacatatactcaggggtcctcataaacagccatctcttcctgtactctataccctgtctagccaggctacacatgaagctgttcatctcctttgcaggatgttggtctttgatccatccaaaagaatatccgctaaggatgccttagcccacccctacctagatgaagggcgactacgatatcacacatgtatgtgtaaatgttgcttttccacctccactggaagagtttataccagtgactttgagcctgtcaccaatcccaaatttgatgacactttcgagaagaacctcagttctgtccgacaggttaaagaaattattcatcagttcattttggaacagcagaaaggaaacagagtgcctctctgcatcaaccctcagtctgctgcttttaagagctttattagttccactgttgctcagccatctgagatgcccccatctcctctggtgtgggagtgatggtggaagataatgtactactgaagatgtaatgtagctttccactggagtctgggatttgcaattctggaggctcctgagaatcaacccaactgaagcatttcaattcacttgaatgagaaacgtgtttagtatcaaaagagcccaagaagacactggtgtgaaaggtacaatctcagaggttggtcaattaccgtggcacactttctggtcactttgtacaatgtagatttgaagtacagtggtgaaaacattaaatgtgacatttgaaaaaaaaaatca

SEQ ID NO: 72388 - DNA, 2417 bp, Homo sapiens
  misc_feature (13)..(13): n is a, c, g, or t
  misc_feature (25)..(25): n is a, c, g, or t
gtttgcgcggggnaccacccgctcncccccccaaccctcctcagcagaagcagccggcggcgggggcaggagtcagcccgcttccgaccgtaccccgcccgcctcccggggctcctgttctttggccccgggaccctaaccttctcccggggcggttccctccgtctgggcgtccgagcgctgcccacatctttcattcctccctgcacctccttcccttcacttttgccccggctctctttctcctctctgtcctgctgtcgcctcctctcctcactccagcctccttccctggcttattctgcccaggaaagtttggaacccccgccccccctccccaatcaggtcaacctgactaggagtagggggagatgtaggaaggcctgagagttcggggggggggaagctggaagctggtttcccagaaaatttccccccatcttctccatttagggtggtgggaattttttttaatcctgtttttgaggaggtggtaggtgtttagaaaaggatgtgggaatggaaggggtagatgagtcaaccctctttcaagattccaagggtggtgtgttacctgatccttttcgtgtgtggagttcagggggtcgggaggtttggcctttattcccacattcaaagttggaacctcccccaaattaagaatggagttttagtacccacttgtggcaggaatcctggggggaaggggtccttttttcctttttcttttcttttttcccttttttttccttttggcaacccacacccttccacacacgctcaccccaaaattaaacaccaagatcctctaacttgtttggattgactgatgaagacataaagctctatgttttttgaggtggagtgagtggtttttcttcatttttaaatggccaaatgacagcttgacccagtttgctttccaatcaaagggcatttattttgaatgtctctttgtggcgcaagagccaacgcaaaaatgatggcggcttacaatggcggtacatctgcagcagcagcaggtcaccaccaccaccatcaccaccaccttccacacctccctcctcctcacctgcaccaccaccaccaccctcaacaccatcttcatccggggtcggctgccgctgtacaccctgtacagcagcacacctcttcggcagctgcggcagccgcagcagcggctgcagctgcagccatgttaaaccctgggcaacaacagccatatttcccatcaccggcaccggggcaggctcctggaccagctgcagcagccccagctcaggtacaggctgccgcagctgctacagttaaggcgcaccatcatcagcactcgcatcatccacagcagcagctggatattgagccggatagacctattggatatggagcctttggtgttgtctggttgagaatctgtagtactgagaagtttctccactatcagccgagattaacagccacagctggattctttgggggctctgctttgtgaaaagagctttgaagaagcagagcctgcaccataaaaaggaaacggttgctcttctagacataacaaagcatccgtatgaaactagaaatgtggaaatctgtattgttaattttaactacaaacgaacttacttttggaaattacaggttcatgatcataaagtagataaagagtagagaataaaagtaacaatctgatgattctgcacccacttcttggtggttgaaactccatagcctataacgttgcaagtcattttgtacttagactcctgaaaagattatccaaattatgttcaaaaaaccacagcacaaaaaataaacttgttttattcttggggagaaatttcatgttatactgtccaatattaatttagaaaaaaagacagtttttttttttaaggcatttcagaaacattgccctttcaagcaagttaaaacaatatccctcaacattaaataccatctttttagccatcagtaccactgggcatgtgtcataaaagagaaatgggggcagatatagctccctttcatatgctataccagaacaaaaatttgtaaaatgcataagtgcattaactgaatatgtttgaatttaaattctgggtttttaccttcaaagcacaggcagctgtagatacaaaaagtcctctaatggagtactggaatgtttcattgtcttcacaacttggagtgtcagagttttctctgccttctatattgtaaaactgagtgactattcttggtcgtttttattagatttattgatgtccaagcaatacaagaattaactgttcatatactgtatgtttccttaacatgcttatttggtttctttgatggagattgtcaaggccaaagaaactttttcatttgtcatccaaccaataaatggacagaagctgttagaagctctttaatta

SEQ ID NO: 72389 - DNA, 2371 bp, Homo sapiens
  misc_feature (13)..(13): n is a, c, g, or t
  misc_feature (25)..(25): n is a, c, g, or t
gtttgcgcggggnaccacccgctcncccccccaaccctcctcagcagaagcagccggcggcgggggcaggagtcagcccgcttccgaccgtaccccgcccgcctcccggggctcctgttctttggccccgggaccctaaccttctcccggggcggttccctccgtctgggcgtccgagcgctgcccacatctttcattcctccctgcacctccttcccttcacttttgccccggctctctttctcctctctgtcctgctgtcgcctcctctcctcactccagcctccttccctggcttattctgcccaggaaagtttggaacccccgccccccctccccaatcaggtcaacctgactaggagtagggggagatgtaggaaggcctgagagttcggggggggggaagctggaagctggtttcccagaaaatttccccccatcttctccatttagggtggtgggaattttttttaatcctgtttttgaggaggtggtaggtgtttagaaaaggatgtgggaatggaaggggtagatgagtcaaccctctttcaagattccaagggtggtgtgttacctgatccttttcgtgtgtggagttcagggggtcgggaggtttggcctttattcccacattcaaagttggaacctcccccaaattaagaatggagttttagtacccacttgtggcaggaatcctggggggaaggggtccttttttcctttttcttttcttttttcccttttttttccttttggcaacccacacccttccacacacgctcaccccaaaattaaacaccaagatcctctaacttgtttggattgactgatgaagacataaagctctatgttttttgaggtggagtgagtggtttttcttcatttttaaatggccaaatgacagcttgacccagtttgctttccaatcaaagggcatttattttgaatgtctctttgtggcgcaagagccaacgcaaaaatgatggcggcttacaatggcggtacatctgcagcagcagcaggtcaccaccaccaccatcaccaccaccttccacacctccctcctcctcacctgcaccaccaccaccaccctcaacaccatcttcatccggggtcggctgccgctgtacaccctgtacagcagcacacctcttcggcagctgcggcagccgcagcagcggctgcagctgcagccatgttaaaccctgggcaacaacagccatatttcccatcaccggcaccggggcaggctctgctacagttaaggcgcaccatcatcagcactcgcatcatccacagcagcagctggatattgagccggatagacctattggatatggagcctttggtgttgtctggttgagaatctgtagtactgagaagtttctccactatcagccgagattaacagccacagctggattctttgggggctctgctttgtgaaaagagctttgaagaagcagagcctgcaccataaaaaggaaacggttgctcttctagacataacaaagcatccgtatgaaactagaaatgtggaaatctgtattgttaattttaactacaaacgaacttacttttggaaattacaggttcatgatcataaagtagataaagagtagagaataaaagtaacaatctgatgattctgcacccacttcttggtggttgaaactccatagcctataacgttgcaagtcattttgtacttagactcctgaaaagattatccaaattatgttcaaaaaaccacagcacaaaaaataaacttgttttattcttggggagaaatttcatgttatactgtccaatattaatttagaaaaaaagacagtttttttttttaaggcatttcagaaacattgccctttcaagcaagttaaaacaatatccctcaacattaaataccatctttttagccatcagtaccactgggcatgtgtcataaaagagaaatgggggcagatatagctccctttcatatgctataccagaacaaaaatttgtaaaatgcataagtgcattaactgaatatgtttgaatttaaattctgggtttttaccttcaaagcacaggcagctgtagatacaaaaagtcctctaatggagtactggaatgtttcattgtcttcacaacttggagtgtcagagttttctctgccttctatattgtaaaactgagtgactattcttggtcgtttttattagatttattgatgtccaagcaatacaagaattaactgttcatatactgtatgtttccttaacatgcttatttggtttctttgatggagattgtcaaggccaaagaaactttttcatttgtcatccaaccaataaatggacagaagctgttagaagctctttaatta

SEQ ID NO: 72390 - DNA, 635 bp, Homo sapiens
  misc_feature (621)..(621): n is a, c, g, or t
ttagggaacaattttaaatcctctactgtttcttccaaggttttttttaaattattggttgagtaaaaggaattaaatatctgcaattaaatctgtttgttatttcaggtttgaaatatctccattcagctggcattttacatcgagacattaagccagggaatctccttgtgaacagcaactgtgttctaaaggtagcttttcagtttatttaaatacctgggaaaaatcagaatgtcagggcaggtttaagaacaacatatttttgtgaaagaaagaagttcatttccattactttaccaaaagttaacccagttttctccatatcactactcatagccatggtaataatttgtagtcctgcctcatgttcttttcatgatatttggcctatgttttagaaacactgaaattggaattgtagtgtaactagaaagaagaatagacaaggtgactcctttacagcttgttccattattaaaagaagtgcatatcagaagaaatattagaacagcaagcatctgtttatataagagaatgaagtgtgacttttaggaagaccatttacatttttacacagctaacatatctatatgctgttgaccaggtagcgaatccatntccgggtaccgctc

SEQ ID NO: 72391 - DNA, 359 bp, Homo sapiens
  misc_feature (330)..(330): n is a, c, g, or t
tactttaagttctggggtacatgtgcagaacgtgtaggtttgttacataggtatacatcagctcaggtacaggctgccgcagctgctacagttaaggcgcaccatcatcagcactcgcatcatccacagcagcagctggatattgagccggatagacggttctctggcagcaggattcccaggcatgcctagctaacaaagaagcatgtcaatcaatttgccgatgtcttgcctagattccatagcccttggatttaactttggtcggggacatgatctttctcctctggcttccgatattctaaccaacacttagtgggaagtatgggntgaagggggatgattacccttcccagcca

SEQ ID NO: 72392 - DNA, 4283 bp, Homo sapiens
  misc_feature (13)..(13): n is a, c, g, or t
  misc_feature (25)..(25): n is a, c, g, or t
gtttgcgcggggnaccacccgctcncccccccaaccctcctcagcagaagcagccggcggcgggggcaggagtcagcccgcttccgaccgtaccccgcccgcctcccggggctcctgttctttggccccgggaccctaaccttctcccggggcggttccctccgtctgggcgtccgagcgctgcccacatctttcattcctccctgcacctccttcccttcacttttgccccggctctctttctcctctctgtcctgctgtcgcctcctctcctcactccagcctccttccctggcttattctgcccaggaaagtttggaacccccgccccccctccccaatcaggtcaacctgactaggagtagggggagatgtaggaaggcctgagagttcggggggggggaagctggaagctggtttcccagaaaatttccccccatcttctccatttagggtggtgggaattttttttaatcctgtttttgaggaggtggtaggtgtttagaaaaggatgtgggaatggaaggggtagatgagtcaaccctctttcaagattccaagggtggtgtgttacctgatccttttcgtgtgtggagttcagggggtcgggaggtttggcctttattcccacattcaaagttggaacctcccccaaattaagaatggagttttagtacccacttgtggcaggaatcctggggggaaggggtccttttttcctttttcttttcttttttcccttttttttccttttggcaacccacacccttccacacacgctcaccccaaaattaaacaccaagatcctctaacttgtttggattgactgatgaagacataaagctctatgttttttgaggtggagtgagtggtttttcttcatttttaaatggccaaatgacagcttgacccagtttgctttccaatcaaagggcatttattttgaatgtctctttgtggcgcaagagccaacgcaaaaatgatggcggcttacaatggcggtacatctgcagcagcagcaggtcaccaccaccaccatcaccaccaccttccacacctccctcctcctcacctgcaccaccaccaccaccctcaacaccatcttcatccggggtcggctgccgctgtacaccctgtacagcagcacacctcttcggcagctgcggcagccgcagcagcggctgcagctgcagccatgttaaaccctgggcaacaacagccatatttcccatcaccggcaccggggcaggctcctggaccagctgcagcagccccagctcaggtacaggctgccgcagctgctacagttaaggcgcaccatcatcagcactcgcatcatccacagcagcagctggatattgagccggatagacctattggatatggagcctttggtgttgtctggtcagtaacagatccaagagatggaaagagagtagcgctcaaaaagatgcccaacgtcttccagaatctggtctcttgcaaaagggtcttccgggaattgaagatgttgtgtttttttaagcatgataatgtactctctgcccttgacatactccaacctccacacattgactattttgaagaaatatatgttgtcacagaattgatgcagagtgacctacataaaattatcgtctctcctcaaccactcagctcagatcatgtcaaagtttttctttatcagattttgcgaggtttgaaatatctccattcagctggcattttacatcgagacattaagccagggaatctccttgtgaacagcaactgtgttctaaagatttgtgattttggattggccagagtggaagaattagatgaatcccgtcatatgactcaggaagttgttactcagtattatcgggctccagaaatcctgatgggcagccgtcattacagcaatgctattgacatctggtctgtgggatgtatctttgcagaactactaggacgaagaatattgtttcaggcacagagtcccattcagcagttggatttgatcacggatctgttgggcacaccatcactggaagcaatgaggacagcttgtgaaggcgctaaggcacatatactcaggggtcctcataaacagccatctcttcctgtactctataccctgtctagccaggctacacatgaagctgttcatctcctttgcaggatgttggtctttgatccatccaaaagaatatccgctaaggatgccttagcccacccctacctagatgaagggcgactacgatatcacacatgtatgtgtaaatgttgcttttccacctccactggaagagtttataccagtgactttgagcctgtcaccaatcccaaatttgatgacactttcgagaagaacctcagttctgtccgacaggttaaagaaattattcatcagttcattttggaacagcagaaaggaaacagagtgcctctctgcatcaaccctcagtctgctgcttttaagagctttattagttccactgttgctcagccatctgagatgcccccatctcctctggtgtgggagtgatggtggaagataatgtactactgaagatgtaatgtagctttccactggagtctgggatttgcaattctggaggttaatcatgcttgtactgtaattttactaatgaagttttaaattaacaaccactacttgtatgatatgaataatatttagaaatgttactagacttttaatcttgtaaagtggttgtgcttttagaagaaaaatattttacccagagttgcacatgttttatgaatttagtgcagctgttatggctcacctcagaacaaaagagaattgaaccaaatttgggagtttggggttttatgttttgtttttcttttctaaaatgaagtgagattgttcacacacacacacacacacacacacacacacaaacacaaaggacagtcatacattttgatatttgagccattcctaaagatttggggttttctaaaactaaagaatctaggaaccttgcctgcgaccaatcatggagccacgtgagctgatcgtggctgcacctggggggagggtagggaggaggggcatgccacctaatgatcaagccctataattagcttctcattagagccgtgatggtgatgtgtgctgtctaaaatccaatgttgtgggtagagagaatgagtttgtgactaggagagactaaacttttgttttccttacccagtataaatatatatatatatatttaatctatttttattagaagtttttctgctctttcttacataaaagaaccccaagcatgcatctttcatgtgtgtaaataattcatttctgggctaatttcaaaagaatcccaatattgctgtatagaaagagaactagcttgcacattttaggtctgtgaaattttgtgagacttttcctgcactggacagtaaaaaaataataaaagacaaaaacaaatttaaaaaaaaatttaagccacaaaaaaaggcacatagggaattatgtcaaatgtgtttgtgtccttaggcaaagctgtgggagtcttgaaatgtcacagtagtaaataacttattactttttgacaagttctttttttctgttggaacactgaattcttctgtgcatatgtacatatgaatacaaatcgaaggcctctacctcctggagttatacaacttggcttgtttacctccacatgctgatgatgactattttttttttttgagttcagtgtggagacttgaaacttgaatgtcccttccaacttttatattaaaaataaaaagacaagaaaattgaagatcatttttcacctgtacaaggaatactaatggatcgtcttaaaattggtctaggaaaaaaccttggtgtgtgttatggacaattaactgttaaagttattgtaagttatctgtatttagcagagtattttcaacttgagtgatctgagctgaatttgaagactattaataagttatgtttggaagttttaacttcaatgaagtaattatttgctgtgaaagaaacaaacattgaattactaaacaaagatggtgcaatatctttgttttttttttatgaggctcctgagaatcaacccaactgaagcatttcaattcacttgaatgagaaacgtgtttagtatcaaaagagcccaagaagacactggtgtgaaaggtacaatctcagaggttggtcaattaccgtggcacactttctggtcactttgtacaatgtagatttgaagtacagtggtgaaaacattaaatgtgacatttgaaaaaaaaaatca

SEQ ID NO: 72393 - DNA, 547 bp, Homo sapiens
gtccccaaagtaaccacctgaaactatacacctagataccaactgaggtctttaagtgatcttcaaaaaggcaataattgccagcaacttagaagagttcacccataatgccaaacctgtggagtctctctcaaatttataggccattttactcttcccactgatggggttgcagtctgtgtaatgccaccagtaggtttcttatatttagcaacagctgtcattttagttttaggaagttcagctgaattctgcttgatagatgatgtgtgtgtttgatttaactaaaccagtaggcagtgcttttcagatgctggctagagttcgctgagaattcactgctcccgggcttgcaaattgtcatggattgtatgatgtttgttttctccacagaaattattcatcagttcattttggaacagcagaaaggaaacagagtgcctctctgcatcaaccctcagtctgctgcttttaagagctttattaggtaactatatgtatgtaattcaacattcttgttagaattaaaaggatgccagtgttactt

SEQ ID NO: 72394 - DNA, 1301 bp, Homo sapiens
ggtgtccgacgctggctccgctctatccggctttgctaggggagctgcggcagccgcagcagcggctgcagctgcagccatgttaaaccctgggcaacaacagccatatttcccatcaccggcaccggggcaggctcctggaccagctgcagcagccccagctcaggtacaggctgccgcagctgctacagttaaggcgcaccatcatcagcactcgcatcatccacagcagcagctggatattgagccggatagacctattggatatggagcctttggtgttgtctggttgagaatctgtagtactgagaagtttctccactatcagccgagattaacagccacagctggattctttgggggctctgctttgtgaaaagagctttgaagaagcagagcctgcaccataaaaaggaaacggttgctcttctagacataacaaagcatccgtatgaaactagaaatgtggaaatctgtattgttaattttaactacaaacgaacttacttttggaaattacaggttcatgatcataaagtagataaagagtagagaataaaagtaacaatctgatgattctgcacccacttcttggtggttgaaactccatagcctataacgttgcaagtcattttgtacttagactcctgaaaagattatccaaattatgttcaaaaaaccacagcacaaaaaataaacttgttttattcttggggagaaatttcatgttatactgtccaatattaatttagaaaaaaagacagtttttttttttaaggcatttcagaaacattgccctttcaagcaagttaaaacaatatccctcaacattaaataccatctttttagccatcagtaccactgggcatgtgtcataaaagagaaatgggggcagatatagctccctttcatatgctataccagaacaaaaatttgtaaaatgcataagtgcattaactgaatatgtttgaatttaaattctgggtttttaccttcaaagcacaggcagctgtagatacaaaaagtcctctaatggagtactggaatgtttcattgtcttcacaacttggagtgtcagagttttctctgccttctatattgtaaaactgagtgactattcttggtcgtttttattagatttattgatgtccaagcaatacaagaattaactgttcatatactgtatgtttccttaacatgcttatttggtttctttgatggagattgtcaaggccaaagaaactttttcatttgtcatccaaccaataaatggacagaagctgttagaagctctttaatta

SEQ ID NO: 72395 - DNA, 2191 bp, Homo sapiens
gtcaagcagttaatgtgtcttttgaaagatcctatgtggacagtcattttatctgtagtgttgatgtgctggtctctaatttgatttcagtccaaaagaatatccgctaaggatgccttagcccacccctacctagatgaagggcgactacgatatcacacatgtatgtgtaaatgttgcttttccacctccactggaagagtttataccagtgactttgagcctgtcaccaatcccaaatttgatgacactttcgagaagaacctcagttctgtccgacaggttaaagaaattattcatcagttcattttggaacagcagaaaggaaacagagtgcctctctgcatcaaccctcagtctgctgcttttaagagctttattagttccactgttgctcagccatctgagatgcccccatctcctctggtgtgggagtgatggtggaagataatgtactactgaagatgtaatgtagctttccactggagtctgggatttgcaattctggaggttaatcatgcttgtactgtaattttactaatgaagttttaaattaacaaccactacttgtatgatatgaataatatttagaaatgttactagacttttaatcttgtaaagtggttgtgcttttagaagaaaaatattttacccagagttgcacatgttttatgaatttagtgcagctgttatggctcacctcagaacaaaagagaattgaaccaaatttgggagtttggggttttatgttttgtttttcttttctaaaatgaagtgagattgttcacacacacacacacacacacacacacacacaaacacaaaggacagtcatacattttgatatttgagccattcctaaagatttggggttttctaaaactaaagaatctaggaaccttgcctgcgaccaatcatggagccacgtgagctgatcgtggctgcacctggggggagggtagggaggaggggcatgccacctaatgatcaagccctataattagcttctcattagagccgtgatggtgatgtgtgctgtctaaaatccaatgttgtgggtagagagaatgagtttgtgactaggagagactaaacttttgttttccttacccagtataaatatatatatatatatttaatctatttttattagaagtttttctgctctttcttacataaaagaaccccaagcatgcatctttcatgtgtgtaaataattcatttctgggctaatttcaaaagaatcccaatattgctgtatagaaagagaactagcttgcacattttaggtctgtgaaattttgtgagacttttcctgcactggacagtaaaaaaataataaaagacaaaaacaaatttaaaaaaaaatttaagccacaaaaaaaggcacatagggaattatgtcaaatgtgtttgtgtccttaggcaaagctgtgggagtcttgaaatgtcacagtagtaaataacttattactttttgacaagttctttttttctgttggaacactgaattcttctgtgcatatgtacatatgaatacaaatcgaaggcctctacctcctggagttatacaacttggcttgtttacctccacatgctgatgatgactattttttttttttgagttcagtgtggagacttgaaacttgaatgtcccttccaacttttatattaaaaataaaaagacaagaaaattgaagatcatttttcacctgtacaaggaatactaatggatcgtcttaaaattggtctaggaaaaaaccttggtgtgtgttatggacaattaactgttaaagttattgtaagttatctgtatttagcagagtattttcaacttgagtgatctgagctgaatttgaagactattaataagttatgtttggaagttttaacttcaatgaagtaattatttgctgtgaaagaaacaaacattgaattactaaacaaagatggtgcaatatctttgttttttttttatgaggctcctgagaatcaacccaactgaagcatttcaattcacttgaatgagaaacgtgtttagtatcaaaagagcccaagaagacactggtgtgaaaggtacaatctcagaggttggtcaattaccgtggcacactttctggtcactttgtacaatgtagatttgaagtacagtggtgaaaacattaaatgtgacatttgaaaaaaaaaatca

SEQ ID NO: 72396 - DNA, 480 bp, Homo sapiens
gatgtgtaaaacttcattttgcctgatgcaaagttcccagtattcttgtcactaatttctttccagaaaatgaaagttataggcttggctgttctctgtggggtgaggaggggagtatggagggcagaggaggagacagaaatgtccaggagccataatctagaacatccaagtccttgaccaacagtttccttaagtacagtgagcctcagctagacagatcctgggggaagttttctgcacagagaacaagctcaggaaattctcctttctttaccacccaaggctttgccgcagccagaaccctcagccattgggcttgtgtggtgcagatcatgtagtcttcttctatggattctgtctgctgataacaggttcttagcctttgctaagagcaaacaatttggactcttggtctcttgtgcctaagttcagactccctgtgaaaacactccaatgaatagaagaggcaaaaaaaaa

SEQ ID NO: 72397 - DNA, 481 bp, Homo sapiens
acacattcccagctgtggtggctatggtgagagatgcctttctgcttgagaaaggcagagggaaaagtaaaggggactttgtcttgcagcttgagtatcagctcagccacagtgggatagaacaccaagtgggcttccagggttcccacttccagacttcaagtcctgtctggcacttctgcactcgccctgggccagagagaaacgcactgctcagaaagaagagactcagtataggtggtagcaaggcagtcgtcaccatagggtttgagcaagaaccagtactgggctggcttcggatctgaactagaggagtctcagtggtcgtggccacaagaatgcttgtgtcacccctcccccagctccaggcagctccatacacacacacacacacagagagagagagagagagagagagagagagagagagagagagagactctgtttgtttggggtaaaggaagaagagaacaagagtctc

SEQ ID NO: 72398 - DNA, 329 bp, Homo sapiens
gtaaattttacaggcagtttattagctttctttaaaacatcatattggaattcttagcaggattacattgagacagtagattaatgtatgatgtttcagtcaaggaacatggcatgtcttttaacttatttattgttaaatgtactttagtaagtgtgtgtagtttttcttccatcctatacatttttgttaggtttataactagatattttatattgtacctggttcataattgggatcccccccatataaattgttattaatgcttaggagaactattgatttttgtctgcagtcagccaccttaaattattttgctattaatttca

SEQ ID NO: 72399 - DNA, 370 bp, Homo sapiens
ttgggaagaagctacctgttaagaaaaaaaaaaaggacaatggcaataactgggatcataattcccaagttttaggtttatacacaaaaatgaggcagtcaaaaacaaaaaaagaaaatttttaaaaatgaggcagtcagtcaaagaagtcagcatccaacattcctgattgcaatgcagtcaacgttcatggagcatggagatacaagaaaataaaagataagaagattggaaagattttactactccagctacttacaaaatccagggcctgtctctctcagataagcagagagattctcctgggcttttggtttgctttttttgtttgtttaatttagtttttgcgttttggtgcttctatcaagta

SEQ ID NO: 72400 - DNA, 407 bp, Homo sapiens
taggagtgagtggccaatgtcaccactgaacctagggtaaagccgaggtccatgatgcacttttctaaggcaacaaggtgctatgatcaacagggacacatgaagtggcatggaggagcattcagtgaggcaaagggaactactggaccaggctcacatctgatttacagtagatttagctccccttcctcaagagacccaaacatattctgtccttaagccattctgtcatagaacctgtctggcttcagggaaagggagaaggcatggtagtataggctaaagacccatttgaccagttgattggcttttgatgatcagtagacacacccctcaatgctgcgaagaaaatgaaggccactcttctaaggttgtaaaaagataaatcattattcatgtgaaaactt

SEQ ID NO: 72401 - DNA, 223 bp, Homo sapiens
tggaccaatacttggtagtgtgtttattatactttattcagatgctctgtagacaagtaggacactcaaagcaatttgtttcttggctaagtcagtattaaaataaggtgaaatctgattggaacactgtgctacttacaatgatcctttttatacatctttacttttgcatcttaccttctgcgtgtttgctcttcttgcctattgaaaggggagtccagaa

SEQ ID NO: 72402 - DNA, 619 bp, Homo sapiens
aggacaaaataaagcctaaatccaagaacacttttaaaaatgaggaaatagtgaacacaatagacggaagtctggaagtttctacccatgccaagaaaagcattttatgttttgttcacatatgttgtgcaattcaaatttttttccctatattctctgactagacacttgtactgagtcaattggcgagtgtgtctgtctaaaagcacaatatcaaaatatcacttaaagcatctttacatagtgtgtttaagaaaaagttgttattcagcagaaaggtaattccaattggtctgcatatttatcagcacttggtattgtctgtttcttattttagccattctgataggtgtgtactgatatctaatcatggctttaatttgaatttccctaatggctgatggtgaacatcttttcatgtgcatttctgtcatctgtatgtctttggtgaagagtcttcaaatcttttgttcatcttaaaattggattgttatattaccattgggtttaagaatctacatattatggatacaaatatgttgtcagatatgtgttttgcagcattttctcccagtctgtagcttgtctttaaaaaaaaaattttttttttttttttttt

SEQ ID NO: 72403 - DNA, 389 bp, Homo sapiens
  misc_feature (26)..(26): n is a, c, g, or t
gtgggagccgaatgatgagaactcantggacacatgtggggaaactggggaaacaacacacactggggcctgcaggagaatgggggtgggaggagggagaccatcaggaaaaatagctaatggatgctgggcttaatacctaggtgatgggatgatctgtgcagcaaaccaccatgacacaggtttagctatgtaacctgcacatcctgcgcatgtacccctgaacttaaaagttagaaaaaggtaaaaattaaagaaaacctgtacatcaaaacttactgaatgtaatgaaagcagcgctcagagggaaatttatagctgtaaaagcctacattataaaagatctaagactaaacacacagagtagactaaacacagaaaacaaaagg

SEQ ID NO: 72404 - DNA, 383 bp, Homo sapiens
ccattctttgcttttgtgttttcttgaggaaattcttccagagtcagacattctctatattctctaaaaacttctcttgtttgagccagagctctgtgagctgcttctcttaaagagctgctcgtggacgatctgccacaaagagttttaaaatgtggtgttggtctcttttttctgaaccacatcaaagagcacagattatttcctttctgagaacaaaactctttaatgacaagaaagaacaagaaactgagccgccaaccagccctatcaggaaagacactgtaaccctaacaatgacaaatgatccacttctacaatctcttgtcactttttgaaatttaaaccaaacacagtaatcatattctcgcatatgtgtctct

SEQ ID NO: 72405 - DNA, 966 bp, Homo sapiens
cagggaaggatccgttttggcgggcggttggcgttgcgcagaaggcggcggcggtggtggcttgtggtgcggcctcaccatacaggaacagggcagacgttagcgtgagtgatcactctcaatcccgggaaggagtccaggtcatcctgagaagagttcgcttgtccagagtccaagatgcagatttgttggatttctgtaagccactcgaagccacatattcatttctgatgacagctttacacttgtgctggaagaacacccactgtgacaactgctgcctatgtttagtctgtccaggagctctaccaactagcatgtttgcagaaaaacctacactgttcttgttagcagctatgtaaatattagatctttctgagtttctcttctcagatctgccaatttctttggggcaaattgtatcctgcagtagcctcaatttaccctttgaaatgagggattaaaggttttagacattctttgggttatctgaaacacaattctttttggatcagtaatgttttatatatgtccactttatgatgtttaaaattttattccccctatgtattagtttcctgtggctgctataacaaattaccacagacttggtggtttaaaacaagaggaatttattcttctcaaaattttggagcccagaagtctgcaatcaagatattgaggcccctctggaggctctaggagagagactgttctttgcctcttttagcttctgattatggtcagcattccttggcatatctctctgttctgttttcacattgtcttctcttttgagtacttgcatcagaactctccctctacctgtgtattataaggatacatatgattgcaattaagaaaccacttggatgaaccaggataaatttctccaatcctatcttttaattcaacctgagagagcagatttaaaatatattttattcctaaagtggcaggtccctg

SEQ ID NO: 72406 - DNA, 864 bp, Homo sapiens
cagggaaggatccgttttggcgggcggttggcgttgcgcagaaggcggcggcggtggtggcttgtggtgcggcctcaccatacaggaacagggcagacgttagcgtgagtgatcactctcaatcccggggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgaggagcacaatacttgggaacctgagaaaaacttggattgccctgagctaatttctgaatttatgaaaaagtataagaagatgaaggagggtgaaaataataaacccagggagaagtcagaaagtaacaagaggaaatccaatttctcaaacagtgccgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagctaaaggaggggatggtctctgtcatttctctttgtacataatacattcacctccctgcctcctctcctttctacccacccctttctatcctaaacacatccataaaaaatgtgcttatcac

SEQ ID NO: 72407 - DNA, 794 bp, Homo sapiens
ctgggaggggaggcccctcctgttagcccagagggaaagaaagaactggggcgatccgggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgaggagcacaatacttgggaacctgagaaaaacttggattgccctgagctaatttctgaatttatgaaaaagtataagaagatgaaggagggtgaaaataataaacccagggagaagtcagaaagtaacaagaggaaatccaatttctcaaacagtgccgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagctaaaggaggggatggtctctgtcatttctctttgtacataatacattcacctccctgcctcctctcctttctacccacccctttctatcctaaacacatccataaaaaatgtgcttatcac

SEQ ID NO: 72408 - DNA, 757 bp, Homo sapiens
  misc_feature (748)..(749): n is a, c, g, or t
cagggaaggatccgttttggcgggcggttggcgttgcgcagaaggcggcggcggtggtggcttgtggtgcggcctcaccatacaggaacagggcagacgttagcgtgagtgatcactctcaatcccggggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgaggagcacaatacttgggaacctgagaaaaacttggattgccctgagctaatttctgaatttatgaaaaagtataagaagatgaaggagggtgaaaataataaacccagggagaagtcagaaagtaacaagaggaaatccaatttctcaaacagtgccgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggactctttgacatatacattcaccctcctgctctnntcttctac

SEQ ID NO: 72409 - DNA, 687 bp, Homo sapiens
cagggaaggatccgttttggcgggcggttggcgttgcgcagaaggcggcggcggtggtggcttgtggtgcggcctcaccatacaggaacagggcagacgttagcgtgagtgatcactctcaatcccggggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgaggagcacaatacttgggaacctgagaaaaacttggattgccctgagctaatttctgaatttatgaaaaagtataagaagatgaaggagggtgaaaatgatcaatgtcctctaagacaatcctcacccagacacaggcaagggagagcgaagaggttcgttagagaaatcaagtaatgccgaactttatggaattgagaactgactttgcaaagctgaattctttgtgcttccaatgtcctcattagaatccctttgaagtacatcagagtataattttcaagagtcaagaacaaagcttcatctagccattggctcaaatggcccaccagcagaaacaaagtatctgaatgctctgctcctcaagccataacgtgcgcag

SEQ ID NO: 72410 - DNA, 906 bp, Homo sapiens
ctgatataaacttttatttttcttccttgcttatagagaatgattttaactgatcattgtactaataggaaggagtccaggtcatcctgagaagagttcgcttgtccagagtccaagatgcagatttgttggatttctgtaagccactcgaagccacatattcatttctgatgacagctttacacttgtgctggaagaacacccactgtgacaactgctgcctatgtttagtctgtccaggagctctaccaactagcatgtttgcagaaaaacctacactgttcttgttagcagctatgtaaatattagatctttctgagtttctcttctcagatctgccaatttctttggggcaaattgtatcctgcagtagcctcaatttaccctttgaaatgagggattaaaggttttagacattctttgggttatctgaaacacaattctttttggatcagtaatgttttatatatgtccactttatgatgtttaaaattttattccccctatgtattagtttcctgtggctgctataacaaattaccacagacttggtggtttaaaacaagaggaatttattcttctcaaaattttggagcccagaagtctgcaatcaagatattgaggcccctctggaggctctaggagagagactgttctttgcctcttttagcttctgattatggtcagcattccttggcatatctctctgttctgttttcacattgtcttctcttttgagtacttgcatcagaactctccctctacctgtgtattataaggatacatatgattgcaattaagaaaccacttggatgaaccaggataaatttctccaatcctatcttttaattcaacctgagagagcagatttaaaatatattttattcctaaagtggcaggtccctg

SEQ ID NO: 72411 - DNA, 313 bp, Homo sapiens
cagggaaggatccgttttggcgggcggttggcgttgcgcagaaggcggcggcggtggtggcttgtggtgcggcctcaccatacaggaacagggcagacgttagcgtgagtgatcactctcaatcccggggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaaggtcaacgctacaggaggaccgtagcttcctcccagaccattacggcc

SEQ ID NO: 72412 - DNA, 195 bp, Homo sapiens
cagggaaggatccgttttggcgggcggttggcgttgcgcagaaggcggcggcggtggtggcttgtggtgcggcctcaccatacaggaacagggcagacgttagcgtgagtgatcactctcaatcccgggtaagtggcagacagtcttatctacccatagtaggtcttgaactgactccatttgggcccgttattg

SEQ ID NO: 72413 - DNA, 8292 bp, Homo sapiens
cagggaaggatccgttttggcgggcggttggcgttgcgcagaaggcggcggcggtggtggcttgtggtgcggcctcaccatacaggaacagggcagacgttagcgtgagtgatcactctcaatcccggggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgaggagcacaatacttgggaacctgagaaaaacttggattgccctgagctaatttctgaatttatgaaaaagtataagaagatgaaggagggtgaaaataataaacccagggagaagtcagaaagtaacaagaggaaatccaatttctcaaacagtgccgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagctaaaggaggggatggtctctgtcatttctctttgtacataatacattcacctccctgcctcctctcctttctacccacccctttctatcctaaacacatccataaaaaatgtgcttatcactgtgctccacaggagaaatgttggtattggttctcttgtaacataactgatggtctgattaatgataagtgtctctctgtgaagaccaggcatttacatactgagtgtaatacccacaatttttttttcctttgccctgatctcttccttctgcttccctgtgacctcaagatgagtttcaactttttaatcaccttagagtcttgatcttttcagggttggtcgctttttaggttgggggattttgttacaatgatgttgaattttggtttcttgctttggttcttagaacatgttgctgactagctggcctttgttctgacatgttgagatggaaaggatgttgcccatctgttaaaaagccaatagcaactgcctacctgttggggctttcccaaccttgttcagctctacccaggagaatacagggtttctggtgtggtcttctgggccaccctctgttgttcatcctcactcatcctcccagaattactccatcctttggaagatttgaaattttacactgaaatctgtcaagacactctttttagccccaggactttcggtattgcttttagcactccccacttctgcttctgtaaagtgatatcaatttgtgataaaatgacaagattattaactgtgcagatttgtagctatagtacatgaggatgatggggtagggtacaattgtctttattatcatatatggtatgtatgtatgatttctttccattcctcatatttagactgtatatttatgtaggtgtgagtgattgcctggtgcttgcttgtgccaaggtgctaggcaccctccaaccctgccaacttttgtggcctcccaaagcattcctgttaccaaagaggcttcaaacctgaccctcacttctcagtggacccgagtttcccttccatgccattattttcagtggggaagttttagaggtgagctgttggccacaatatcaattttaagtgttcatagcagttatgtctcctgcattcttggctcctggatttaccaccaagagtccccaaaatattaatgctcttccctttttctaccctcaaacttatagttgtatcttattttttaaaatgaattttcatggccaggcacagtggctaccgcctgtaatcccagcactttgggaggctgagggcaggagaattgcttgaagccagaagtttgagaccagcctgggcaatgtagtgagaccccctgtctctaaaaaatataaataaaaataaaggcatgttcctgaaagactgtcaccttggaaagtgacaggccctggcattagcatgttgacacacccttttcttcttactcagcaaaatacttcgttttggtttcttcttgtgttgctattgagaaatttgtctgatcatatccttctgcctttgtcccccaagaaatgccctactttatccttttctttttgtagttgaggagggctagagaatcacaattaaaagtaaggaaatagcagggttttgaggatccttgtcccagccccaaagctgaggaaataagaataaatgcttaatatagccttaattctagagcgcaccagccatgaggctgcttttcttgttgtttttgatttttaaaacatacagctgtctggccaggagcatctaccatttctagattattcagagtaatgaggggaatggatggattgctccagtccacagatgagccacataatatgcaaatcatatacccattcatagcatttgttaacattgcttccctgctcagctgctgattgaattctgtgtgcttatataaattatgtcaaaaattatactgcataattgaggtgacagctgttgctgcagtgacatgacagactggaacaatgaagcttttggtttaagtcagccaggaaaatccttctgaatggtaatgtgattgggcaagagctcataaaccatacctcaagtgggtgggagttttatctctatattccttctctctctgaaggaattaaaggcctagatcaagtgctggataattgacaattgcttgtacttaatctgatcggtatctaaaagaaggaaaggatggtcaggaaacatttatcataaatgtagccaaggatatcaattagggtagacaagaataggacaaaaataggccagagctcctgaggaggtgatatgggtctcttgatttgcagaaaatgacagcctatccaagtggcccagtgtatgcctcccagtagcagtgggcatgtaaactgcagcgaccttatttttaaaaccaaaaacctagtatgtggacaaagaacatgacaatatttggtactgagattggttctgagaaacctggggcatgtggctgctgtggttataggtaatatttaagacattcataaaaatctgatattcttttaccgaaataaccccagtatcatctactacttaccatctgttaatagactttactctgtcttttttgtcttcggtttattgtactgagtgccgccaaaacaacttttgttctcttcctgcctacctgcagctggttctataggaatgtagggagccagaggccagtattgatttcagcccttagcacaaaggaaatcagatgcctgcttccagcatttgttagtgttgagtagatgttcttgccctagaagaattacagcctcaaacagaaacctgtttcatggagctttctcccctcagaagagttaatagttaagagctaagcactcttaaacacctaagtctcaaatgctaaaaatttatttttcttgtgtttagtcctctttcaagacatctttctaagcctttcagtaatcaacattaaaagatctccctttcttcagagttatagcacagctttgcccagtagaggctaccaaggacagcttagcagccctttgattgctgggctgggcagatggccttcaagttaagatcaaatgccgggaaaatcagcctacatgggagcacccattttaaacctggagagaaccatgatgttttcttcttcaaataacaatctagttttttttcccccagtactaaaattgtattgtctttcagacaatataatttttatttaaaattggaacatactatcttcatgctttctaagctaaatcttcatttagatttcactcctcagtagatcccagagaagaagctatataggatccagattcaaatttaacagtgtcttctacttttttagttatgttttctatcaactcctgctgccttttcaaatacggatatttttcaggagactcttctacttgtccactgactgtattttttcctttttgatccgtagccctggttaaatggctgacatccttccgtggatgattcttggaggtagtctcagaattccaaagtgattgtctgtcttcttcttgtcttgatcctaatgcagacattcacctctattatttatttattttttttagacagagtctcgctctgtcaccaggctggagtgcagtggcacaatcttggcttactgtaccctccacctcctgggttcaagcgattctcctgcctcagcctctcgagtagctgggactacaggtgtgtgccaccatgcccagctaatttttgtatttttggtagagatggggttttaccatgtttgccaggatggtctcgatttcctgaccttgtgatctgcccaccttggcctcccaaagtgctggaattacaggcatgagccaccgtgcctggccacctctattaaatttttgtggacaaaaataaaattgtcattatttgtttgctctcatggagcactttcagtaatacaattttttttaaattccagttgccctctttgttgctctgtcctctgtaatacctgactttgctaaagacttgaggggtggtttcagaggagggtcaggtgatgggaaggcaggatgagaaaagccctggacttgcatgtttgagaaggcttccaaccacatcttcactcagactcttggaattcctgtccccaaaacaagcttctgttttttgctcacaatgctatatttctaaatttttcctgaattactgagaagcagtcattagctttgttaagtttggtttggggacattgttggtatcaaaaatcgaagtcttattcatttgatgtaggccatgaatcatcaataactggttgctggaaagcttgactaccatccactggggtgctattttgagaaggatttttgggtatctttatagtctgcaattagttgatgattgctttctagtttatcaactgcatttatatttgcttttctgttcatggaaaatcctttatttgctggggttttttgtttgtttgtttgtttttcccacttacagcaagtaaaagtggtctgaggttatccttgtttttcttcgcggtttgccatgtgtgaaagtagatttcctgctattgatatattctcattatagacagaatagtggagaacagtgttgccatggacaaaatccagttttggtccactctggggagcatttggacctgtggtgcttctaacaattaaaagtctagatggtccttgactgtcccccagccatactgcatactactttgtgcattctactttgtgtcattaatgaaagattggttctgtccctgtaacttaggcatttattattcttaactcttcattcctgttctgtagccacccagcagtccattttccctatgttcaggccaaaccacagggcattggggaaggtttttgggattttcttattgagattttgttgaatctgtagtttaccccagctttcctaaggtacagtgaggggttggagggatctgtgtttggcccggggagcaattgtctctaccttaaggttcagttttgagggcataaaatactactttgcaatgtcatgagaacaccattagatctgaaatgtggaaatggtttctcacaatttaaaggaaaaacccactttgcacccatgatcccatcattttggttgagattttagaataaaaaatatagtgttgagatccgtacttttgtaatcagaccaccaagcatgcctgtggcaaggcagagaggaaaggtctggagccagtgtattgcagtttcatgctacctttacctgctaatcataaaaattatgttttcaaaagtagatgatactagccttacacccaaaaacatgttctgaattagatgccccctcacccaatttttattaagctttctaaattccagccacattgctgtacatcaacattggtttcattcaacagacatttttttggcctgaagatacaaggttcagaaagaggccatccctgccctcaaataactttcatactggtgtatgatgaactgaccattaatagtttaagtgcttacaagctatgtttctgttcaaaaaaaaaatagtttggtataataaatgctataaaccaatacacatttctgacttgggggcagagacagactggctgatgttgtatagtttgtagccctggagtaagaagttgacattaatttcggcctatatgtggaaaagacctataacattgggtgaactgagccagctggccatagaacacaagaacatattccaggaaataaatatagctggagggttggaaatgctgttattactgagagagaaaacaggtgagttgggattgagaactcctgattttcatccctggtttagattcttggccaaagtagtggtagagttaatctttgcttgtggaaagcattaactatgttgcagattcagttgtgttacattattgtgggttctataacaacatattcctcatggacactttaccagagttgctcacacctttttcaatttctcatcccttttggaggaatgaacatgagacttaactgcctttaagcctaaaacggacatgctttccaatgacaagagattttctaaagagaagtcttggagcacatctgttaatacctgagcatctactctgagcagtgcagttttattcaatactggagagagggtgatttctttttttttgagacggagtcttgctctgtctcccaggctggagtgcagtggcgcaatctcggctcactgcaagctccacctcccgggttcacgccattctcctgcctcagcctcccgaggagctgggactacaggcgccggccaccacgcccggctaattttttgtatttttagtagagacggggtttcaccttgttagccaggatggtctcaatctcctgacctcatgatccacccacctcggcctcccagagtgctgggattacaggcgtgagccaccgccgggccgagagggtgatttctaagcagagaattgtatcagttatgtggaaacctttgccagaaatacatataccttgtatattaaatctgagtctcagatttaatcatcgaagcgtagctgggttaagaaacagtctgatcgtaaggatgttgtcgattctgacccatggatgaccacaagaaaaagatatttatttctgcctggataattgagagttgactaactttggaagtcagaattcccaggaattagagtaactgctctggaaagttaaagtgtgaagttttttagatagtttcataaaaacaattctggtttctttttgcttgtgctgactttcttggattttaatctacctcatcttgtctttttagagttacttcaacttgtcactttaacattgtgcttgactttggttgttttctaagatggaatttttcctgttcattgacagcttgttctcttgccttttcattctgatcctcatttcatctaacatcatctcatattgctcctctgtcaagagaaatgttttaaaatagtttaaagtcttgttttatgggaagaaagtgatcctccaatgctatttgtttctgaggtcagtaagagaaggagttaaaacaaggcagtggggaagggaatgaatcctgcactggaggcaaaagctgacaaggaaagagccattaattaagacaatttcaaagtcaactgattgtgatcattaatgtcacaatagatcaaaacctaattatcacagcctaggtaagagccatcagtattaatcggaaaatctaataggaaactattatcaagaaattaggccaaattgaatgcagtgaactttttatcttggcattctctatttttttgtgatgtcccctggcattggcaggtgtgaccctaacagtcgattcaaggccaagtggtcagtttgtcagccttttttaagggatttctttttatttttaggaattccaaacagagttaacctaaactgtcattgccaaaagatcagtcttaaactttcttagcacctgtacctgtttaatgtgatcagctatcagtgaggaaaaaaaaaaaaatctatttaggtcttggaatggttcctgtacctagagtatccatattga

SEQ ID NO: 72414 - DNA, 7121 bp, Homo sapiens
cagggaaggatccgttttggcgggcggttggcgttgcgcagaaggcggcggcggtggtggcttgtggtgcggcctcaccatacaggaacagggcagacgttagcgtgagtgatcactctcaatcccggggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgaggagcacaatacttgggaacctgagaaaaacttggattgccctgagctaatttctgaatttatgaaaaagtataagaagatgaaggagggtgaaaataataaacccagggagaagtcagaaagtaacaagaggaaatccaatttctcaaacagtgccgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagctaaaggaggggatggtctctgtcatttctctttgtacataatacattcacctccctgcctcctctcctttctacccacccctttctatcctaaacacatccataaaaaatgtgcttatcactgtgctccacaggagaaatgttggtattggttctcttgtaacataactgatggtctgattaatgataagtgtctctctgtgaagaccaggcatttacatactgagtgtaatacccacaatttttttttcctttgccctgatctcttccttctgcttccctgtgacctcaagatgagtttcaactttttaatcaccttagagtcttgatcttttcagggttggtcgctttttaggttgggggattttgttacaatgatgttgaattttggtttcttgctttggttcttagaacatgttgctgactagctggcctttgttctgacatgttgagatggaaaggatgttgcccatctgttaaaaagccaatagcaactgcctacctgttggggctttcccaaccttgttcagctctacccaggagaatacagggtttctggtgtggtcttctgggccaccctctgttgttcatcctcactcatcctcccagaattactccatcctttggaagatttgaaattttacactgaaatctgtcaagacactctttttagccccaggactttcggtattgcttttagcactccccacttctgcttctgtaaagtgatatcaatttgtgataaaatgacaagattattaactgtgcagatttgtagctatagtacatgaggatgatggggtagggtacaattgtctttattatcatatatggtatgtatgtatgatttctttccattcctcatatttagactgtatatttatgtaggtgtgagtgattgcctggtgcttgcttgtgccaaggtgctaggcaccctccaaccctgccaacttttgtggcctcccaaagcattcctgttaccaaagaggcttcaaacctgaccctcacttctcagtggacccgagtttcccttccatgccattattttcagtggggaagttttagaggtgagctgttggccacaatatcaattttaagtgttcatagcagttatgtctcctgcattcttggctcctggatttaccaccaagagtccccaaaatattaatgctcttccctttttctaccctcaaacttatagttgtatcttattttttaaaatgaattttcatggccaggcacagtggctaccgcctgtaatcccagcactttgggaggctgagggcaggagaattgcttgaagccagaagtttgagaccagcctgggcaatgtagtgagaccccctgtctctaaaaaatataaataaaaataaaggcatgttcctgaaagactgtcaccttggaaagtgacaggccctggcattagcatgttgacacacccttttcttcttactcagcaaaatacttcgttttggtttcttcttgtgttgctattgagaaatttgtctgatcatatccttctgcctttgtcccccaagaaatgccctactttatccttttctttttgtagttgaggagggctagagaatcacaattaaaagtaaggaaatagcagggttttgaggatccttgtcccagccccaaagctgaggaaataagaataaatgcttaatatagccttaattctagagcgcaccagccatgaggctgcttttcttgttgtttttgatttttaaaacatacagctgtctggccaggagcatctaccatttctagattattcagagtaatgaggggaatggatggattgctccagtccacagatgagccacataatatgcaaatcatatacccattcatagcatttgttaacattgcttccctgctcagctgctgattgaattctgtgtgcttatataaattatgtcaaaaattatactgcataattgaggtgacagctgttgctgcagtgacatgacagactggaacaatgaagcttttggtttaagtcagccaggaaaatccttctgaatggtaatgtgattgggcaagagctcataaaccatacctcaagtgggtgggagttttatctctatattccttctctctctgaaggaattaaaggcctagatcaagtgctggataattgacaattgcttgtacttaatctgatcggtatctaaaagaaggaaaggatggtcaggaaacatttatcataaatgtagccaaggatatcaattagggtagacaagaataggacaaaaataggccagagctcctgaggaggtgatatgggtctcttgatttgcagaaaatgacagcctatccaagtggcccagtgtatgcctcccagtagcagtgggcatgtaaactgcagcgaccttatttttaaaaccaaaaacctagtatgtggacaaagaacatgacaatatttggtactgagattggttctgagaaacctggggcatgtggctgctgtggttataggtaatatttaagacattcataaaaatctgatattcttttaccgaaataaccccagtatcatctactacttaccatctgttaatagactttactctgtcttttttgtcttcggtttattgtactgagtgccgccaaaacaacttttgttctcttcctgcctacctgcagctggttctataggaatgtagggagccagaggccagtattgatttcagcccttagcacaaaggaaatcagatgcctgcttccagcatttgttagtgttgagtagatgttcttgccctagaagaattacagcctcaaacagaaacctgtttcatggagctttctcccctcagaagagttaatagttaagagctaagcactcttaaacacctaagtctcaaatgctaaaaatttatttttcttgtgtttagtcctctttcaagacatctttctaagcctttcagtaatcaacattaaaagatctccctttcttcagagttatagcacagctttgcccagtagaggctaccaaggacagcttagcagccctttgattgctgggctgggcagatggccttcaagttaagatcaaatgccgggaaaatcagcctacatgggagcacccattttaaacctggagagaaccatgatgttttcttcttcaaataacaatctagttttttttcccccagtactaaaattgtattgtctttcagacaatataatttttatttaaaattggaacatactatcttcatgctttctaagctaaatcttcatttagatttcactcctcagtagatcccagagaagaagctatataggatccagattcaaatttaacagtgtcttctacttttttagttatgttttctatcaactcctgctgccttttcaaatacggatatttttcaggagactcttctacttgtccactgactgtattttttcctttttgatccgtagccctggttaaatggctgacatccttccgtggatgattcttggaggtagtctcagaattccaaagtgattgtctgtcttcttcttgtcttgatcctaatgcagacattcacctctattatttatttattttttttagacagagtctcgctctgtcaccaggctggagtgcagtggcacaatcttggcttactgtaccctccacctcctgggttcaagcgattctcctgcctcagcctctcgagtagctgggactacaggtgtgtgccaccatgcccagctaatttttgtatttttggtagagatggggttttaccatgtttgccaggatggtctcgatttcctgaccttgtgatctgcccaccttggcctcccaaagtgctggaattacaggcatgagccaccgtgcctggccacctctattaaatttttgtggacaaaaataaaattgtcattatttgtttgctctcatggagcactttcagtaatacaattttttttaaattccagttgccctctttgttgctctgtcctctgtaatacctgactttgctaaagacttgaggggtggtttcagaggagggtcaggtgatgggaaggcaggatgagaaaagccctggacttgcatgtttgagaaggcttccaaccacatcttcactcagactcttggaattcctgtccccaaaacaagcttctgttttttgctcacaatgctatatttctaaatttttcctgaattactgagaagcagtcattagctttgttaagtttggtttggggacattgttggtatcaaaaatcgaagtcttattcatttgatgtaggccatgaatcatcaataatttcatactggtgtatgatgaactgaccattaatagtttaagtgcttacaagctatgtttctgttcaaaaaaaaaatagtttggtataataaatgctataaaccaatacacatttctgacttgggggcagagacagactggctgatgttgtatagtttgtagccctggagtaagaagttgacattaatttcggcctatatgtggaaaagacctataacattgggtgaactgagccagctggccatagaacacaagaacatattccaggaaataaatatagctggagggttggaaatgctgttattactgagagagaaaacaggtgagttgggattgagaactcctgattttcatccctggtttagattcttggccaaagtagtggtagagttaatctttgcttgtggaaagcattaactatgttgcagattcagttgtgttacattattgtgggttctataacaacatattcctcatggacactttaccagagttgctcacacctttttcaatttctcatcccttttggaggaatgaacatgagacttaactgcctttaagcctaaaacggacatgctttccaatgacaagagattttctaaagagaagtcttggagcacatctgttaatacctgagcatctactctgagcagtgcagttttattcaatactggagagagggtgatttctttttttttgagacggagtcttgctctgtctcccaggctggagtgcagtggcgcaatctcggctcactgcaagctccacctcccgggttcacgccattctcctgcctcagcctcccgaggagctgggactacaggcgccggccaccacgcccggctaattttttgtatttttagtagagacggggtttcaccttgttagccaggatggtctcaatctcctgacctcatgatccacccacctcggcctcccagagtgctgggattacaggcgtgagccaccgccgggccgagagggtgatttctaagcagagaattgtatcagttatgtggaaacctttgccagaaatacatataccttgtatattaaatctgagtctcagatttaatcatcgaagcgtagctgggttaagaaacagtctgatcgtaaggatgttgtcgattctgacccatggatgaccacaagaaaaagatatttatttctgcctggataattgagagttgactaactttggaagtcagaattcccaggaattagagtaactgctctggaaagttaaagtgtgaagttttttagatagtttcataaaaacaattctggtttctttttgcttgtgctgactttcttggattttaatctacctcatcttgtctttttagagttacttcaacttgtcactttaacattgtgcttgactttggttgttttctaagatggaatttttcctgttcattgacagcttgttctcttgccttttcattctgatcctcatttcatctaacatcatctcatattgctcctctgtcaagagaaatgttttaaaatagtttaaagtcttgttttatgggaagaaagtgatcctccaatgctatttgtttctgaggtcagtaagagaaggagttaaaacaaggcagtggggaagggaatgaatcctgcactggaggcaaaagctgacaaggaaagagccattaattaagacaatttcaaagtcaactgattgtgatcattaatgtcacaatagatcaaaacctaattatcacagcctaggtaagagccatcagtattaatcggaaaatctaataggaaactattatcaagaaattaggccaaattgaatgcagtgaactttttatcttggcattctctatttttttgtgatgtcccctggcattggcaggtgtgaccctaacagtcgattcaaggccaagtggtcagtttgtcagccttttttaagggatttctttttatttttaggaattccaaacagagttaacctaaactgtcattgccaaaagatcagtcttaaactttcttagcacctgtacctgtttaatgtgatcagctatcagtgaggaaaaaaaaaaaaatctatttaggtcttggaatggttcctgtacctagagtatccatattga

SEQ ID NO: 72415 - DNA, 8098 bp, Homo sapiens
cagggaaggatccgttttggcgggcggttggcgttgcgcagaaggcggcggcggtggtggcttgtggtgcggcctcaccatacaggaacagggcagacgttagcgtgagtgatcactctcaatcccggggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgaggagcacaatacttgggaacctgagaaaaacttggattgccctgagctaatttctgaatttatgaaaaagtataagaagatgaaggagggtgaaaataataaacccagggagaagtcagaaagtaacaagaggaaatccaatttctcaaacagtgccgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagctaaaggaggggatggtctctgtcatttctctttgtacataatacattcacctccctgcctcctctcctttctacccacccctttctatcctaaacacatccataaaaaatgtgcttatcactgtgctccacaggagaaatgttggtattggttctcttgtaacataactgatggtctgattaatgataagtgtctctctgtgaagaccaggcatttacatactgagtgtaatacccacaatttttttttcctttgccctgatctcttccttctgcttccctgtgacctcaagatgagtttcaactttttaatcaccttagagtcttgatcttttcagggttggtcgctttttaggttgggggattttgttacaatgatgttgaattttggtttcttgctttggttcttagaacatgttgctgactagctggcctttgttctgacatgttgagatggaaaggatgttgcccatctgttaaaaagccaatagcaactgcctacctgttggggctttcccaaccttgttcagctctacccaggagaatacagggtttctggtgtggtcttctgggccaccctctgttgttcatcctcactcatcctcccagaattactccatcctttggaagatttgaaattttacactgaaatctgtcaagacactctttttagccccaggactttcggtattgcttttagcactccccacttctgcttctgtaaagtgatatcaatttgtgataaaatgacaagattattaactgtgcagatttgtagctatagtacatgaggatgatggggtagggtacaattgtctttattatcatatatggtatgtatgtatgatttctttccattcctcatatttagactgtatatttatgtaggtgtgagtgattgcctggtgcttgcttgtgccaaggtgctaggcaccctccaaccctgccaacttttgtggcctcccaaagcattcctgttaccaaagaggcttcaaacctgaccctcacttctcagtggacccgagtttcccttccatgccattattttcagtggggaagttttagaggtgagctgttggccacaatatcaattttaagtgttcatagcagttatgtctcctgcattcttggctcctggatttaccaccaagagtccccaaaatattaatgctcttccctttttctaccctcaaacttatagttgtatcttattttttaaaatgaattttcatggccaggcacagtggctaccgcctgtaatcccagcactttgggaggctgagggcaggagaattgcttgaagccagaagtttgagaccagcctgggcaatgtagtgagaccccctgtctctaaaaaatataaataaaaataaaggcatgttcctgaaagactgtcaccttggaaagtgacaggccctggcattagcatgttgacacacccttttcttcttactcagcaaaatacttcgttttggtttcttcttgtgttgctattgagaaatttgtctgatcatatccttctgcctttgtcccccaagaaatgccctactttatccttttctttttgtagttgaggagggctagagaatcacaattaaaagtaaggaaatagcagggttttgaggatccttgtcccagccccaaagctgaggaaataagaataaatgcttaatatagccttaattctagagcgcaccagccatgaggctgcttttcttgttgtttttgatttttaaaacatacagctgtctggccaggagcatctaccatttctagattattcagagtaatgaggggaatggatggattgctccagtccacagatgagccacataatatgcaaatcatatacccattcatagcatttgttaacattgcttccctgctcagctgctgattgaattctgtgtgcttatataaattatgtcaaaaattatactgcataattgaggtgacagctgttgctgcagtgacatgacagactggaacaatgaagcttttggtttaagtcagccaggaaaatccttctgaatggtaatgtgattgggcaagagctcataaaccatacctcaagtgggtgggagttttatctctatattccttctctctctgaaggaattaaaggcctagatcaagtgctggataattgacaattgcttgtacttaatctgatcggtatctaaaagaaggaaaggatggtcaggaaacatttatcataaatgtagccaaggatatcaattagggtagacaagaataggacaaaaataggccagagctcctgaggaggtgatatgggtctcttgatttgcagaaaatgacagcctatccaagtggcccagtgtatgcctcccagtagcagtgggcatgtaaactgcagcgaccttatttttaaaaccaaaaacctagtatgtggacaaagaacatgacaatatttggtactgagattggttctgagaaacctggggcatgtggctgctgtggttataggtaatatttaagacattcataaaaatctgatattcttttaccgaaataaccccagtatcatctactacttaccatctgttaatagactttactctgtcttttttgtcttcggtttattgtactgagtgccgccaaaacaacttttgttctcttcctgcctacctgcagctggttctataggaatgtagggagccagaggccagtattgatttcagcccttagcacaaaggaaatcagatgcctgcttccagcatttgttagtgttgagtagatgttcttgccctagaagaattacagcctcaaacagaaacctgtttcatggagctttctcccctcagaagagttaatagttaagagctaagcactcttaaacacctaagtctcaaatgctaaaaatttatttttcttgtgtttagtcctctttcaagacatctttctaagcctttcagtaatcaacattaaaagatctccctttcttcagagttatagcacagctttgcccagtagaggctaccaaggacagcttagcagccctttgattgctgggctgggcagatggccttcaagttaagatcaaatgccgggaaaatcagcctacatgggagcacccattttaaacctggagagaaccatgatgttttcttcttcaaataacaatctagttttttttcccccagtactaaaattgtattgtctttcagacaatataatttttatttaaaattggaacatactatcttcatgctttctaagctaaatcttcatttagatttcactcctcagtagatcccagagaagaagctatataggatccagattcaaatttaacagtgtcttctacttttttagttatgttttctatcaactcctgctgccttttcaaatacggatatttttcaggagactcttctacttgtccactgactgtattttttcctttttgatccgtagccctggttaaatggctgacatccttccgtggatgattcttggaggtagtctcagaattccaaagtgattgtctgtcttcttcttgtcttgatcctaatgcagacattcacctctattatttatttattttttttagacagagtctcgctctgtcaccaggctggagtgcagtggcacaatcttggcttactgtaccctccacctcctgggttcaagcgattctcctgcctcagcctctcgagtagctgggactacaggtgtgtgccaccatgcccagctaatttttgtatttttggtagagatggggttttaccatgtttgccaggatggtctcgatttcctgaccttgtgatctgcccaccttggcctcccaaagtgctggaattacaggcatgagccaccgtgcctggccacctctattaaatttttgtggacaaaaataaaattgtcattatttgtttgctctcatggagcactttcagtaatacaattttttttaaattccagttgccctctttgttgctctgtcctctgtaatacctgactttgctaaagacttgaggggtggtttcagaggagggtcaggtgatgggaaggcaggatgagaaaagccctggacttgcatgtttgagaaggcttccaaccacatcttcactcagactcttggaattcctgtccccaaaacaagcttctgttttttgctcacaatgctatatttctaaatttttcctgaattactgagaagcagtcattagctttgttaagtttggtttggggacattgttggtatcaaaaatcgaagtcttattcatttgatgtaggccatgaatcatcaataactggttgctggaaagcttgactaccatccactggggtgctattttgagaaggatttttgggtatctttatagtctgcaattagttgatgattgctttctagtttatcaactgcatttatatttgcttttctgttcatggaaaatcctttatttgctggggttttttgtttgtttgtttgtttttcccacttacagcaagtaaaagtggtctgaggttatccttgtttttcttcgcggtttgccatgtgtgaaagtagatttcctgctattgatatattctcattatagacagaatagtggagaacagtgttgccatggacaaaatccagttttggtccactctggggagcatttggacctgtggtgcttctaacaattaaaagtctagatggtccttgactgtcccccagccatactgcatactactttgtgcattctactttgtgtcattaatgaaagattggttctgtccctgtaacttaggcatttattattcttaactcttcattcctgttctgtagccacccagcagtccattttccctatgttcaggccaaaccacagggcattggggaaggtttttgggattttcttattgagattttgttgaatctgtagtttaccccagctttcctaaggtacagtgaggggttggagggatctgtgtttggcccggggagcaattgtctctaccttaaggttcagttttgagggcataaaatactactttgcaatgtcatgagaacaccattagatctgaaatgtggaaatggtttctcacaatttaaaggaaaaacccactttgcacccatgatcccatcattttggttgagattttagaataaaaaatatagtgttgagatccgtacttttgtaatcagaccaccaagcatgcctgtggcaaggcagagaggaaaggtctggagccagtgtattgcagtttcatgctacctttacctgctaatcataaaaattatgttttcaaaagtagatgatactagccttacacccaaaaacatgttctgaattagatgccccctcacccaatttttattaagctttctaaattccagccacattgctgtacatcaacattggtttcattcaacagacatttttttggcctgaagatacaaggttcagaaagaggccatccctgccctcaaataactttcatactggtgtatgatgaactgaccattaatagtttaagtgcttacaagctatgtttctgttcaaaaaaaaaatagtttggtataataaatgctataaaccaatacacatttctgacttgggggcagagacagactggctgatgttgtatagtttgtagccctggagtaagaagttgacattaatttcggcctatatgtggaaaagacctataacattgggtgaactgagccagctggccatagaacacaagaacatattccaggaaataaatatagctggagggttggaaatgctgttattactgagagagaaaacaggtgagttgggattgagaactcctgattttcatccctggtttagattcttggccaaagtagtggtagagttaatctttgcttgtggaaagcattaactatgttgcagattcagttgtgttacattattgtgggttctataacaacatattcctcatggacactttaccagagttgctcacacctttttcaatttctcatcccttttggaggaatgaacatgagacttaactgcctttaagcctaaaacggacatgctttccaatgacaagagattttctaaagagaagtcttggagcacatctgttaatacctgagcatctactctgtctcaagaaaaaaaaaacaaaaacaaaaacagaactctgcctcatagcgtcttttaagttatacactggacctatcctttcctcactgacagacattttaaaaattttttggtaaggcctagttcatataaaatgtaatccaagccaaaagttaacaagaataaggggaggaaaggggactccaatagcagagaaaggtatttacctgggatatacactgcaagaaaatcaaagctataagaaacgtccatgaatagtagccataaggcatcagagtgataaaattcctgtccctaggagggaatattggagtttgccagagaaacagaatgagagagacagagaggtttattgtaggaattggctcatatgattacggaggctgagaagacccacgatctgccatctgcaagctggagaatcaggaaagctggaggtgtaattcagtcaagtccaatggccagagaagcaagtgtactgatatccaagagcaggagaaaatagatgtcccagaacaagcagagaggctgattttgtccttcctctgcctttttgtttcatatggggcactgaatggactgatgcccatccacattagtgagggtggatcttctttactcagtctaccagtagaaatgtcaatgacttccagaaacaccctcaccaacacacgtggaaataatgttttaccaggtatctgggcatcccttggttcactcaagttgacacaaaattaaccatcacagaaggagactggccttactctgaaattaggaaactaaagaagtgaccagaatggagactaggtagagacaactagttctctaccaaacatgtacagttattcgttggtatctgaaggggattggttccaggaactctcagggataccaaaatctgcaggtgctcaagtcatttatataaaatattacagtatttgcatataacctttgcacatcttccatatactttaaatcatctctacattacttataataatgaatgtgtaaatgctatgaaaatagttactacactattgtttatttgtatttttattgaattgttttggggtggggggcagctgtatctttcttagtaatagaacccctggttttagctgggcacatgactgccctcaataaagattaaagtaccccagccttccttgagattgtggccatgtgactgaactttagacagtgagatataagcagatatcttctgtggcagtgttaggaaactattaaagacagtaagaac

SEQ ID NO: 72416 - DNA, 8222 bp, Homo sapiens
ctgggaggggaggcccctcctgttagcccagagggaaagaaagaactggggcgatccgggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgaggagcacaatacttgggaacctgagaaaaacttggattgccctgagctaatttctgaatttatgaaaaagtataagaagatgaaggagggtgaaaataataaacccagggagaagtcagaaagtaacaagaggaaatccaatttctcaaacagtgccgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagctaaaggaggggatggtctctgtcatttctctttgtacataatacattcacctccctgcctcctctcctttctacccacccctttctatcctaaacacatccataaaaaatgtgcttatcactgtgctccacaggagaaatgttggtattggttctcttgtaacataactgatggtctgattaatgataagtgtctctctgtgaagaccaggcatttacatactgagtgtaatacccacaatttttttttcctttgccctgatctcttccttctgcttccctgtgacctcaagatgagtttcaactttttaatcaccttagagtcttgatcttttcagggttggtcgctttttaggttgggggattttgttacaatgatgttgaattttggtttcttgctttggttcttagaacatgttgctgactagctggcctttgttctgacatgttgagatggaaaggatgttgcccatctgttaaaaagccaatagcaactgcctacctgttggggctttcccaaccttgttcagctctacccaggagaatacagggtttctggtgtggtcttctgggccaccctctgttgttcatcctcactcatcctcccagaattactccatcctttggaagatttgaaattttacactgaaatctgtcaagacactctttttagccccaggactttcggtattgcttttagcactccccacttctgcttctgtaaagtgatatcaatttgtgataaaatgacaagattattaactgtgcagatttgtagctatagtacatgaggatgatggggtagggtacaattgtctttattatcatatatggtatgtatgtatgatttctttccattcctcatatttagactgtatatttatgtaggtgtgagtgattgcctggtgcttgcttgtgccaaggtgctaggcaccctccaaccctgccaacttttgtggcctcccaaagcattcctgttaccaaagaggcttcaaacctgaccctcacttctcagtggacccgagtttcccttccatgccattattttcagtggggaagttttagaggtgagctgttggccacaatatcaattttaagtgttcatagcagttatgtctcctgcattcttggctcctggatttaccaccaagagtccccaaaatattaatgctcttccctttttctaccctcaaacttatagttgtatcttattttttaaaatgaattttcatggccaggcacagtggctaccgcctgtaatcccagcactttgggaggctgagggcaggagaattgcttgaagccagaagtttgagaccagcctgggcaatgtagtgagaccccctgtctctaaaaaatataaataaaaataaaggcatgttcctgaaagactgtcaccttggaaagtgacaggccctggcattagcatgttgacacacccttttcttcttactcagcaaaatacttcgttttggtttcttcttgtgttgctattgagaaatttgtctgatcatatccttctgcctttgtcccccaagaaatgccctactttatccttttctttttgtagttgaggagggctagagaatcacaattaaaagtaaggaaatagcagggttttgaggatccttgtcccagccccaaagctgaggaaataagaataaatgcttaatatagccttaattctagagcgcaccagccatgaggctgcttttcttgttgtttttgatttttaaaacatacagctgtctggccaggagcatctaccatttctagattattcagagtaatgaggggaatggatggattgctccagtccacagatgagccacataatatgcaaatcatatacccattcatagcatttgttaacattgcttccctgctcagctgctgattgaattctgtgtgcttatataaattatgtcaaaaattatactgcataattgaggtgacagctgttgctgcagtgacatgacagactggaacaatgaagcttttggtttaagtcagccaggaaaatccttctgaatggtaatgtgattgggcaagagctcataaaccatacctcaagtgggtgggagttttatctctatattccttctctctctgaaggaattaaaggcctagatcaagtgctggataattgacaattgcttgtacttaatctgatcggtatctaaaagaaggaaaggatggtcaggaaacatttatcataaatgtagccaaggatatcaattagggtagacaagaataggacaaaaataggccagagctcctgaggaggtgatatgggtctcttgatttgcagaaaatgacagcctatccaagtggcccagtgtatgcctcccagtagcagtgggcatgtaaactgcagcgaccttatttttaaaaccaaaaacctagtatgtggacaaagaacatgacaatatttggtactgagattggttctgagaaacctggggcatgtggctgctgtggttataggtaatatttaagacattcataaaaatctgatattcttttaccgaaataaccccagtatcatctactacttaccatctgttaatagactttactctgtcttttttgtcttcggtttattgtactgagtgccgccaaaacaacttttgttctcttcctgcctacctgcagctggttctataggaatgtagggagccagaggccagtattgatttcagcccttagcacaaaggaaatcagatgcctgcttccagcatttgttagtgttgagtagatgttcttgccctagaagaattacagcctcaaacagaaacctgtttcatggagctttctcccctcagaagagttaatagttaagagctaagcactcttaaacacctaagtctcaaatgctaaaaatttatttttcttgtgtttagtcctctttcaagacatctttctaagcctttcagtaatcaacattaaaagatctccctttcttcagagttatagcacagctttgcccagtagaggctaccaaggacagcttagcagccctttgattgctgggctgggcagatggccttcaagttaagatcaaatgccgggaaaatcagcctacatgggagcacccattttaaacctggagagaaccatgatgttttcttcttcaaataacaatctagttttttttcccccagtactaaaattgtattgtctttcagacaatataatttttatttaaaattggaacatactatcttcatgctttctaagctaaatcttcatttagatttcactcctcagtagatcccagagaagaagctatataggatccagattcaaatttaacagtgtcttctacttttttagttatgttttctatcaactcctgctgccttttcaaatacggatatttttcaggagactcttctacttgtccactgactgtattttttcctttttgatccgtagccctggttaaatggctgacatccttccgtggatgattcttggaggtagtctcagaattccaaagtgattgtctgtcttcttcttgtcttgatcctaatgcagacattcacctctattatttatttattttttttagacagagtctcgctctgtcaccaggctggagtgcagtggcacaatcttggcttactgtaccctccacctcctgggttcaagcgattctcctgcctcagcctctcgagtagctgggactacaggtgtgtgccaccatgcccagctaatttttgtatttttggtagagatggggttttaccatgtttgccaggatggtctcgatttcctgaccttgtgatctgcccaccttggcctcccaaagtgctggaattacaggcatgagccaccgtgcctggccacctctattaaatttttgtggacaaaaataaaattgtcattatttgtttgctctcatggagcactttcagtaatacaattttttttaaattccagttgccctctttgttgctctgtcctctgtaatacctgactttgctaaagacttgaggggtggtttcagaggagggtcaggtgatgggaaggcaggatgagaaaagccctggacttgcatgtttgagaaggcttccaaccacatcttcactcagactcttggaattcctgtccccaaaacaagcttctgttttttgctcacaatgctatatttctaaatttttcctgaattactgagaagcagtcattagctttgttaagtttggtttggggacattgttggtatcaaaaatcgaagtcttattcatttgatgtaggccatgaatcatcaataactggttgctggaaagcttgactaccatccactggggtgctattttgagaaggatttttgggtatctttatagtctgcaattagttgatgattgctttctagtttatcaactgcatttatatttgcttttctgttcatggaaaatcctttatttgctggggttttttgtttgtttgtttgtttttcccacttacagcaagtaaaagtggtctgaggttatccttgtttttcttcgcggtttgccatgtgtgaaagtagatttcctgctattgatatattctcattatagacagaatagtggagaacagtgttgccatggacaaaatccagttttggtccactctggggagcatttggacctgtggtgcttctaacaattaaaagtctagatggtccttgactgtcccccagccatactgcatactactttgtgcattctactttgtgtcattaatgaaagattggttctgtccctgtaacttaggcatttattattcttaactcttcattcctgttctgtagccacccagcagtccattttccctatgttcaggccaaaccacagggcattggggaaggtttttgggattttcttattgagattttgttgaatctgtagtttaccccagctttcctaaggtacagtgaggggttggagggatctgtgtttggcccggggagcaattgtctctaccttaaggttcagttttgagggcataaaatactactttgcaatgtcatgagaacaccattagatctgaaatgtggaaatggtttctcacaatttaaaggaaaaacccactttgcacccatgatcccatcattttggttgagattttagaataaaaaatatagtgttgagatccgtacttttgtaatcagaccaccaagcatgcctgtggcaaggcagagaggaaaggtctggagccagtgtattgcagtttcatgctacctttacctgctaatcataaaaattatgttttcaaaagtagatgatactagccttacacccaaaaacatgttctgaattagatgccccctcacccaatttttattaagctttctaaattccagccacattgctgtacatcaacattggtttcattcaacagacatttttttggcctgaagatacaaggttcagaaagaggccatccctgccctcaaataactttcatactggtgtatgatgaactgaccattaatagtttaagtgcttacaagctatgtttctgttcaaaaaaaaaatagtttggtataataaatgctataaaccaatacacatttctgacttgggggcagagacagactggctgatgttgtatagtttgtagccctggagtaagaagttgacattaatttcggcctatatgtggaaaagacctataacattgggtgaactgagccagctggccatagaacacaagaacatattccaggaaataaatatagctggagggttggaaatgctgttattactgagagagaaaacaggtgagttgggattgagaactcctgattttcatccctggtttagattcttggccaaagtagtggtagagttaatctttgcttgtggaaagcattaactatgttgcagattcagttgtgttacattattgtgggttctataacaacatattcctcatggacactttaccagagttgctcacacctttttcaatttctcatcccttttggaggaatgaacatgagacttaactgcctttaagcctaaaacggacatgctttccaatgacaagagattttctaaagagaagtcttggagcacatctgttaatacctgagcatctactctgagcagtgcagttttattcaatactggagagagggtgatttctttttttttgagacggagtcttgctctgtctcccaggctggagtgcagtggcgcaatctcggctcactgcaagctccacctcccgggttcacgccattctcctgcctcagcctcccgaggagctgggactacaggcgccggccaccacgcccggctaattttttgtatttttagtagagacggggtttcaccttgttagccaggatggtctcaatctcctgacctcatgatccacccacctcggcctcccagagtgctgggattacaggcgtgagccaccgccgggccgagagggtgatttctaagcagagaattgtatcagttatgtggaaacctttgccagaaatacatataccttgtatattaaatctgagtctcagatttaatcatcgaagcgtagctgggttaagaaacagtctgatcgtaaggatgttgtcgattctgacccatggatgaccacaagaaaaagatatttatttctgcctggataattgagagttgactaactttggaagtcagaattcccaggaattagagtaactgctctggaaagttaaagtgtgaagttttttagatagtttcataaaaacaattctggtttctttttgcttgtgctgactttcttggattttaatctacctcatcttgtctttttagagttacttcaacttgtcactttaacattgtgcttgactttggttgttttctaagatggaatttttcctgttcattgacagcttgttctcttgccttttcattctgatcctcatttcatctaacatcatctcatattgctcctctgtcaagagaaatgttttaaaatagtttaaagtcttgttttatgggaagaaagtgatcctccaatgctatttgtttctgaggtcagtaagagaaggagttaaaacaaggcagtggggaagggaatgaatcctgcactggaggcaaaagctgacaaggaaagagccattaattaagacaatttcaaagtcaactgattgtgatcattaatgtcacaatagatcaaaacctaattatcacagcctaggtaagagccatcagtattaatcggaaaatctaataggaaactattatcaagaaattaggccaaattgaatgcagtgaactttttatcttggcattctctatttttttgtgatgtcccctggcattggcaggtgtgaccctaacagtcgattcaaggccaagtggtcagtttgtcagccttttttaagggatttctttttatttttaggaattccaaacagagttaacctaaactgtcattgccaaaagatcagtcttaaactttcttagcacctgtacctgtttaatgtgatcagctatcagtgaggaaaaaaaaaaaaatctatttaggtcttggaatggttcctgtacctagagtatccatattga

SEQ ID NO: 72417 - DNA, 8461 bp, Homo sapiens
ctgggaggggaggcccctcctgttagcccagagggaaagaaagaactggggcgatccggtaggtaaaggagggaacccccattcattttctacctttggggctcctcttctgcatgaaggtataaagggagattttccttgtctctccctcaaaatgaagaacacatgtaaatccttgtttttcctggtgaggcaggggaggccatagccacaatgcttaactgcatgcatctaacatggggctggttttaaccccagcgctctgacctaaactgctcagctcccggaaattccaagggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgaggagcacaatacttgggaacctgagaaaaacttggattgccctgagctaatttctgaatttatgaaaaagtataagaagatgaaggagggtgaaaataataaacccagggagaagtcagaaagtaacaagaggaaatccaatttctcaaacagtgccgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagctaaaggaggggatggtctctgtcatttctctttgtacataatacattcacctccctgcctcctctcctttctacccacccctttctatcctaaacacatccataaaaaatgtgcttatcactgtgctccacaggagaaatgttggtattggttctcttgtaacataactgatggtctgattaatgataagtgtctctctgtgaagaccaggcatttacatactgagtgtaatacccacaatttttttttcctttgccctgatctcttccttctgcttccctgtgacctcaagatgagtttcaactttttaatcaccttagagtcttgatcttttcagggttggtcgctttttaggttgggggattttgttacaatgatgttgaattttggtttcttgctttggttcttagaacatgttgctgactagctggcctttgttctgacatgttgagatggaaaggatgttgcccatctgttaaaaagccaatagcaactgcctacctgttggggctttcccaaccttgttcagctctacccaggagaatacagggtttctggtgtggtcttctgggccaccctctgttgttcatcctcactcatcctcccagaattactccatcctttggaagatttgaaattttacactgaaatctgtcaagacactctttttagccccaggactttcggtattgcttttagcactccccacttctgcttctgtaaagtgatatcaatttgtgataaaatgacaagattattaactgtgcagatttgtagctatagtacatgaggatgatggggtagggtacaattgtctttattatcatatatggtatgtatgtatgatttctttccattcctcatatttagactgtatatttatgtaggtgtgagtgattgcctggtgcttgcttgtgccaaggtgctaggcaccctccaaccctgccaacttttgtggcctcccaaagcattcctgttaccaaagaggcttcaaacctgaccctcacttctcagtggacccgagtttcccttccatgccattattttcagtggggaagttttagaggtgagctgttggccacaatatcaattttaagtgttcatagcagttatgtctcctgcattcttggctcctggatttaccaccaagagtccccaaaatattaatgctcttccctttttctaccctcaaacttatagttgtatcttattttttaaaatgaattttcatggccaggcacagtggctaccgcctgtaatcccagcactttgggaggctgagggcaggagaattgcttgaagccagaagtttgagaccagcctgggcaatgtagtgagaccccctgtctctaaaaaatataaataaaaataaaggcatgttcctgaaagactgtcaccttggaaagtgacaggccctggcattagcatgttgacacacccttttcttcttactcagcaaaatacttcgttttggtttcttcttgtgttgctattgagaaatttgtctgatcatatccttctgcctttgtcccccaagaaatgccctactttatccttttctttttgtagttgaggagggctagagaatcacaattaaaagtaaggaaatagcagggttttgaggatccttgtcccagccccaaagctgaggaaataagaataaatgcttaatatagccttaattctagagcgcaccagccatgaggctgcttttcttgttgtttttgatttttaaaacatacagctgtctggccaggagcatctaccatttctagattattcagagtaatgaggggaatggatggattgctccagtccacagatgagccacataatatgcaaatcatatacccattcatagcatttgttaacattgcttccctgctcagctgctgattgaattctgtgtgcttatataaattatgtcaaaaattatactgcataattgaggtgacagctgttgctgcagtgacatgacagactggaacaatgaagcttttggtttaagtcagccaggaaaatccttctgaatggtaatgtgattgggcaagagctcataaaccatacctcaagtgggtgggagttttatctctatattccttctctctctgaaggaattaaaggcctagatcaagtgctggataattgacaattgcttgtacttaatctgatcggtatctaaaagaaggaaaggatggtcaggaaacatttatcataaatgtagccaaggatatcaattagggtagacaagaataggacaaaaataggccagagctcctgaggaggtgatatgggtctcttgatttgcagaaaatgacagcctatccaagtggcccagtgtatgcctcccagtagcagtgggcatgtaaactgcagcgaccttatttttaaaaccaaaaacctagtatgtggacaaagaacatgacaatatttggtactgagattggttctgagaaacctggggcatgtggctgctgtggttataggtaatatttaagacattcataaaaatctgatattcttttaccgaaataaccccagtatcatctactacttaccatctgttaatagactttactctgtcttttttgtcttcggtttattgtactgagtgccgccaaaacaacttttgttctcttcctgcctacctgcagctggttctataggaatgtagggagccagaggccagtattgatttcagcccttagcacaaaggaaatcagatgcctgcttccagcatttgttagtgttgagtagatgttcttgccctagaagaattacagcctcaaacagaaacctgtttcatggagctttctcccctcagaagagttaatagttaagagctaagcactcttaaacacctaagtctcaaatgctaaaaatttatttttcttgtgtttagtcctctttcaagacatctttctaagcctttcagtaatcaacattaaaagatctccctttcttcagagttatagcacagctttgcccagtagaggctaccaaggacagcttagcagccctttgattgctgggctgggcagatggccttcaagttaagatcaaatgccgggaaaatcagcctacatgggagcacccattttaaacctggagagaaccatgatgttttcttcttcaaataacaatctagttttttttcccccagtactaaaattgtattgtctttcagacaatataatttttatttaaaattggaacatactatcttcatgctttctaagctaaatcttcatttagatttcactcctcagtagatcccagagaagaagctatataggatccagattcaaatttaacagtgtcttctacttttttagttatgttttctatcaactcctgctgccttttcaaatacggatatttttcaggagactcttctacttgtccactgactgtattttttcctttttgatccgtagccctggttaaatggctgacatccttccgtggatgattcttggaggtagtctcagaattccaaagtgattgtctgtcttcttcttgtcttgatcctaatgcagacattcacctctattatttatttattttttttagacagagtctcgctctgtcaccaggctggagtgcagtggcacaatcttggcttactgtaccctccacctcctgggttcaagcgattctcctgcctcagcctctcgagtagctgggactacaggtgtgtgccaccatgcccagctaatttttgtatttttggtagagatggggttttaccatgtttgccaggatggtctcgatttcctgaccttgtgatctgcccaccttggcctcccaaagtgctggaattacaggcatgagccaccgtgcctggccacctctattaaatttttgtggacaaaaataaaattgtcattatttgtttgctctcatggagcactttcagtaatacaattttttttaaattccagttgccctctttgttgctctgtcctctgtaatacctgactttgctaaagacttgaggggtggtttcagaggagggtcaggtgatgggaaggcaggatgagaaaagccctggacttgcatgtttgagaaggcttccaaccacatcttcactcagactcttggaattcctgtccccaaaacaagcttctgttttttgctcacaatgctatatttctaaatttttcctgaattactgagaagcagtcattagctttgttaagtttggtttggggacattgttggtatcaaaaatcgaagtcttattcatttgatgtaggccatgaatcatcaataactggttgctggaaagcttgactaccatccactggggtgctattttgagaaggatttttgggtatctttatagtctgcaattagttgatgattgctttctagtttatcaactgcatttatatttgcttttctgttcatggaaaatcctttatttgctggggttttttgtttgtttgtttgtttttcccacttacagcaagtaaaagtggtctgaggttatccttgtttttcttcgcggtttgccatgtgtgaaagtagatttcctgctattgatatattctcattatagacagaatagtggagaacagtgttgccatggacaaaatccagttttggtccactctggggagcatttggacctgtggtgcttctaacaattaaaagtctagatggtccttgactgtcccccagccatactgcatactactttgtgcattctactttgtgtcattaatgaaagattggttctgtccctgtaacttaggcatttattattcttaactcttcattcctgttctgtagccacccagcagtccattttccctatgttcaggccaaaccacagggcattggggaaggtttttgggattttcttattgagattttgttgaatctgtagtttaccccagctttcctaaggtacagtgaggggttggagggatctgtgtttggcccggggagcaattgtctctaccttaaggttcagttttgagggcataaaatactactttgcaatgtcatgagaacaccattagatctgaaatgtggaaatggtttctcacaatttaaaggaaaaacccactttgcacccatgatcccatcattttggttgagattttagaataaaaaatatagtgttgagatccgtacttttgtaatcagaccaccaagcatgcctgtggcaaggcagagaggaaaggtctggagccagtgtattgcagtttcatgctacctttacctgctaatcataaaaattatgttttcaaaagtagatgatactagccttacacccaaaaacatgttctgaattagatgccccctcacccaatttttattaagctttctaaattccagccacattgctgtacatcaacattggtttcattcaacagacatttttttggcctgaagatacaaggttcagaaagaggccatccctgccctcaaataactttcatactggtgtatgatgaactgaccattaatagtttaagtgcttacaagctatgtttctgttcaaaaaaaaaatagtttggtataataaatgctataaaccaatacacatttctgacttgggggcagagacagactggctgatgttgtatagtttgtagccctggagtaagaagttgacattaatttcggcctatatgtggaaaagacctataacattgggtgaactgagccagctggccatagaacacaagaacatattccaggaaataaatatagctggagggttggaaatgctgttattactgagagagaaaacaggtgagttgggattgagaactcctgattttcatccctggtttagattcttggccaaagtagtggtagagttaatctttgcttgtggaaagcattaactatgttgcagattcagttgtgttacattattgtgggttctataacaacatattcctcatggacactttaccagagttgctcacacctttttcaatttctcatcccttttggaggaatgaacatgagacttaactgcctttaagcctaaaacggacatgctttccaatgacaagagattttctaaagagaagtcttggagcacatctgttaatacctgagcatctactctgagcagtgcagttttattcaatactggagagagggtgatttctttttttttgagacggagtcttgctctgtctcccaggctggagtgcagtggcgcaatctcggctcactgcaagctccacctcccgggttcacgccattctcctgcctcagcctcccgaggagctgggactacaggcgccggccaccacgcccggctaattttttgtatttttagtagagacggggtttcaccttgttagccaggatggtctcaatctcctgacctcatgatccacccacctcggcctcccagagtgctgggattacaggcgtgagccaccgccgggccgagagggtgatttctaagcagagaattgtatcagttatgtggaaacctttgccagaaatacatataccttgtatattaaatctgagtctcagatttaatcatcgaagcgtagctgggttaagaaacagtctgatcgtaaggatgttgtcgattctgacccatggatgaccacaagaaaaagatatttatttctgcctggataattgagagttgactaactttggaagtcagaattcccaggaattagagtaactgctctggaaagttaaagtgtgaagttttttagatagtttcataaaaacaattctggtttctttttgcttgtgctgactttcttggattttaatctacctcatcttgtctttttagagttacttcaacttgtcactttaacattgtgcttgactttggttgttttctaagatggaatttttcctgttcattgacagcttgttctcttgccttttcattctgatcctcatttcatctaacatcatctcatattgctcctctgtcaagagaaatgttttaaaatagtttaaagtcttgttttatgggaagaaagtgatcctccaatgctatttgtttctgaggtcagtaagagaaggagttaaaacaaggcagtggggaagggaatgaatcctgcactggaggcaaaagctgacaaggaaagagccattaattaagacaatttcaaagtcaactgattgtgatcattaatgtcacaatagatcaaaacctaattatcacagcctaggtaagagccatcagtattaatcggaaaatctaataggaaactattatcaagaaattaggccaaattgaatgcagtgaactttttatcttggcattctctatttttttgtgatgtcccctggcattggcaggtgtgaccctaacagtcgattcaaggccaagtggtcagtttgtcagccttttttaagggatttctttttatttttaggaattccaaacagagttaacctaaactgtcattgccaaaagatcagtcttaaactttcttagcacctgtacctgtttaatgtgatcagctatcagtgaggaaaaaaaaaaaaatctatttaggtcttggaatggttcctgtacctagagtatccatattga

SEQ ID NO: 72418 - DNA, 6709 bp, Homo sapiens
cagggaaggatccgttttggcgggcggttggcgttgcgcagaaggcggcggcggtggtggcttgtggtgcggcctcaccatacaggaacagggcagacgttagcgtgagtgatcactctcaatcccggggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgaggagcacaatacttgggaacctgagaaaaacttggattgccctgagctaatttctgaatttatgaaaaagtataagaagatgaaggagggtgaaaataataaacccagggagaagtcagaaagtaacaagaggaaatccaatttctcaaacagtgccgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagctaaaggaggggatggtctctgtcatttctctttgtacataatacattcacctccctgcctcctctcctttctacccacccctttctatcctaaacacatccataaaaaatgtgcttatcactgtgctccacaggagaaatgttggtattggttctcttgtaacataactgatggtctgattaatgataagtgtctctctgtgaagaccaggcatttacatactgagtgtaatacccacaatttttttttcctttgccctgatctcttccttctgcttccctgtgacctcaagatgagtttcaactttttaatcaccttagagtcttgatcttttcagggttggtcgctttttaggttgggggattttgttacaatgatgttgaattttggtttcttgctttggttcttagaacatgttgctgactagctggcctttgttctgacatgttgagatggaaaggatgttgcccatctgttaaaaagccaatagcaactgcctacctgttggggctttcccaaccttgttcagctctacccaggagaatacagggtttctggtgtggtcttctgggccaccctctgttgttcatcctcactcatcctcccagaattactccatcctttggaagatttgaaattttacactgaaatctgtcaagacactctttttagccccaggactttcggtattgcttttagcactccccacttctgcttctgtaaagtgatatcaatttgtgataaaatgacaagattattaactgtgcagatttgtagctatagtacatgaggatgatggggtagggtacaattgtctttattatcatatatggtatgtatgtatgatttctttccattcctcatatttagactgtatatttatgtaggtgtgagtgattgcctggtgcttgcttgtgccaaggtgctaggcaccctccaaccctgccaacttttgtggcctcccaaagcattcctgttaccaaagaggcttcaaacctgaccctcacttctcagtggacccgagtttcccttccatgccattattttcagtggggaagttttagaggtgagctgttggccacaatatcaattttaagtgttcatagcagttatgtctcctgcattcttggctcctggatttaccaccaagagtccccaaaatattaatgctcttccctttttctaccctcaaacttatagttgtatcttattttttaaaatgaattttcatggccaggcacagtggctaccgcctgtaatcccagcactttgggaggctgagggcaggagaattgcttgaagccagaagtttgagaccagcctgggcaatgtagtgagaccccctgtctctaaaaaatataaataaaaataaaggcatgttcctgaaagactgtcaccttggaaagtgacaggccctggcattagcatgttgacacacccttttcttcttactcagcaaaatacttcgttttggtttcttcttgtgttgctattgagaaatttgtctgatcatatccttctgcctttgtcccccaagaaatgccctactttatccttttctttttgtagttgaggagggctagagaatcacaattaaaagtaaggaaatagcagggttttgaggatccttgtcccagccccaaagctgaggaaataagaataaatgcttaatatagccttaattctagagcgcaccagccatgaggctgcttttcttgttgtttttgatttttaaaacatacagctgtctggccaggagcatctaccatttctagattattcagagtaatgaggggaatggatggattgctccagtccacagatgagccacataatatgcaaatcatatacccattcatagcatttgttaacattgcttccctgctcagctgctgattgaattctgtgtgcttatataaattatgtcaaaaattatactgcataattgaggtgacagctgttgctgcagtgacatgacagactggaacaatgaagcttttggtttaagtcagccaggaaaatccttctgaatggtaatgtgattgggcaagagctcataaaccatacctcaagtgggtgggagttttatctctatattccttctctctctgaaggaattaaaggcctagatcaagtgctggataattgacaattgcttgtacttaatctgatcggtatctaaaagaaggaaaggatggtcaggaaacatttatcataaatgtagccaaggatatcaattagggtagacaagaataggacaaaaataggccagagctcctgaggaggtgatatgggtctcttgatttgcagaaaatgacagcctatccaagtggcccagtgtatgcctcccagtagcagtgggcatgtaaactgcagcgaccttatttttaaaaccaaaaacctagtatgtggacaaagaacatgacaatatttggtactgagattggttctgagaaacctggggcatgtggctgctgtggttataggtaatatttaagacattcataaaaatctgatattcttttaccgaaataaccccagtatcatctactacttaccatctgttaatagactttactctgtcttttttgtcttcggtttattgtactgagtgccgccaaaacaacttttgttctcttcctgcctacctgcagctggttctataggaatgtagggagccagaggccagtattgatttcagcccttagcacaaaggaaatcagatgcctgcttccagcatttgttagtgttgagtagatgttcttgccctagaagaattacagcctcaaacagaaacctgtttcatggagctttctcccctcagaagagttaatagttaagagctaagcactcttaaacacctaagtctcaaatgctaaaaatttatttttcttgtgtttagtcctctttcaagacatctttctaagcctttcagtaatcaacattaaaagatctccctttcttcagagttatagcacagctttgcccagtagaggctaccaaggacagcttagcagccctttgattgctgggctgggcagatggccttcaagttaagatcaaatgccgggaaaatcagcctacatgggagcacccattttaaacctggagagaaccatgatgttttcttcttcaaataacaatctagttttttttcccccagtactaaaattgtattgtctttcagacaatataatttttatttaaaattggaacatactatcttcatgctttctaagctaaatcttcatttagatttcactcctcagtagatcccagagaagaagctatataggatccagattcaaatttaacagtgtcttctacttttttagttatgttttctatcaactcctgctgccttttcaaatacggatatttttcaggagactcttctacttgtccactgactgtattttttcctttttgatccgtagccctggttaaatggctgacatccttccgtggatgattcttggaggtagtctcagaattccaaagtgattgtctgtcttcttcttgtcttgatcctaatgcagacattcacctctattatttatttattttttttagacagagtctcgctctgtcaccaggctggagtgcagtggcacaatcttggcttactgtaccctccacctcctgggttcaagcgattctcctgcctcagcctctcgagtagctgggactacaggtgtgtgccaccatgcccagctaatttttgtatttttggtagagatggggttttaccatgtttgccaggatggtctcgatttcctgaccttgtgatctgcccaccttggcctcccaaagtgctggaattacaggcatgagccaccgtgcctggccacctctattaaatttttgtggacaaaaataaaattgtcattatttgtttgctctcatggagcactttcagtaatacaattttttttaaattccagttgccctctttgttgctctgtcctctgtaatacctgactttgctaaagacttgaggggtggtttcagaggagggtcaggtgatgggaaggcaggatgagaaaagccctggacttgcatgtttgagaaggcttccaaccacatcttcactcagactcttggaattcctgtccccaaaacaagcttctgttttttgctcacaatgctatatttctaaatttttcctgaattactgagaagcagtcattagctttgttaagtttggtttggggacattgttggtatcaaaaatcgaagtcttattcatttgatgtaggccatgaatcatcaataactggttgctggaaagcttgactaccatccactggggtgctattttgagaaggatttttgggtatctttatagtctgcaattagttgatgattgctttctagtttatcaactgcatttatatttgcttttctgttcatggaaaatcctttatttgctggggttttttgtttgtttgtttgtttttcccacttacagcaagtaaaagtggtctgaggttatccttgtttttcttcgcggtttgccatgtgtgaaagtagatttcctgctattgatatattctcattatagacagaatagtggagaacagtgttgccatggacaaaatccagttttggtccactctggggagcatttggacctgtggtgcttctaacaattaaaagtctagatggtccttgactgtcccccagccatactgcatactactttgtgcattctactttgtgtcattaatgaaagattggttctgtccctgtaacttaggcatttattattcttaactcttcattcctgttctgtagccacccagcagtccattttccctatgttcaggccaaaccacagggcattggggaaggtttttgggattttcttattgagattttgttgaatctgtagtttaccccagctttcctaaggtacagtgaggggttggagggatctgtgtttggcccggggagcaattgtctctaccttaaggttcagttttgagggcataaaatactactttgcaatgtcatgagaacaccattagatctgaaatgtggaaatggtttctcacaatttaaaggaaaaacccactttgcacccatgatcccatcattttggttgagattttagaataaaaaatatagtgttgagatccgtacttttgtaatcagaccaccaagcatgcctgtggcaaggcagagaggaaaggtctggagccagtgtattgcagtttcatgctacctttacctgctaatcataaaaattatgttttcaaaagtagatgatactagccttacacccaaaaacatgttctgaattagatgccccctcacccaatttttattaagctttctaaattccagccacattgctgtacatcaacattggtttcattcaacagacatttttttggcctgaagatacaaggttcagaaagaggccatccctgccctcaaataactttcatactggtgtatgatgaactgaccattaatagtttaagtgcttacaagctatgtttctgttcaaaaaaaaaatagtttggtataataaatgctataaaccaatacacatttctgacttgggggcagagacagactggctgatgttgtatagtttgtagccctggagtaagaagttgacattaatttcggcctatatgtggaaaagacctataacattgggtgaactgagccagctggccatagaacacaagaacatattccaggaaataaatatagctggagggttggaaatgctgttattactgagagagaaaacaggtgagttgggattgagaactcctgattttcatccctggtttagattcttggccaaagtagtggtagagttaatctttgcttgtggaaagcattaactatgttgcagattcagttgtgttacattattgtgggttctgcaccaggcgtttcttcatgtgtttcctcttctcctactcggaaagtggggtccgagctga

SEQ ID NO: 72419 - DNA, 8255 bp, Homo sapiens
cagggaaggatccgttttggcgggcggttggcgttgcgcagaaggcggcggcggtggtggcttgtggtgcggcctcaccatacaggaacagggcagacgttagcgtgagtgatcactctcaatcccggggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgaggagcacaatacttgggaacctgagaaaaacttggattgccctgagctaatttctgaatttatgaaaaagtataagaagatgaaggagggtgaaaataataaacccagggagaagtcagaaagtaacaagaggaaatccaatttctcaaacagtgccgatgacatcaaatctaaaaaaaagagagagtggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagctaaaggaggggatggtctctgtcatttctctttgtacataatacattcacctccctgcctcctctcctttctacccacccctttctatcctaaacacatccataaaaaatgtgcttatcactgtgctccacaggagaaatgttggtattggttctcttgtaacataactgatggtctgattaatgataagtgtctctctgtgaagaccaggcatttacatactgagtgtaatacccacaatttttttttcctttgccctgatctcttccttctgcttccctgtgacctcaagatgagtttcaactttttaatcaccttagagtcttgatcttttcagggttggtcgctttttaggttgggggattttgttacaatgatgttgaattttggtttcttgctttggttcttagaacatgttgctgactagctggcctttgttctgacatgttgagatggaaaggatgttgcccatctgttaaaaagccaatagcaactgcctacctgttggggctttcccaaccttgttcagctctacccaggagaatacagggtttctggtgtggtcttctgggccaccctctgttgttcatcctcactcatcctcccagaattactccatcctttggaagatttgaaattttacactgaaatctgtcaagacactctttttagccccaggactttcggtattgcttttagcactccccacttctgcttctgtaaagtgatatcaatttgtgataaaatgacaagattattaactgtgcagatttgtagctatagtacatgaggatgatggggtagggtacaattgtctttattatcatatatggtatgtatgtatgatttctttccattcctcatatttagactgtatatttatgtaggtgtgagtgattgcctggtgcttgcttgtgccaaggtgctaggcaccctccaaccctgccaacttttgtggcctcccaaagcattcctgttaccaaagaggcttcaaacctgaccctcacttctcagtggacccgagtttcccttccatgccattattttcagtggggaagttttagaggtgagctgttggccacaatatcaattttaagtgttcatagcagttatgtctcctgcattcttggctcctggatttaccaccaagagtccccaaaatattaatgctcttccctttttctaccctcaaacttatagttgtatcttattttttaaaatgaattttcatggccaggcacagtggctaccgcctgtaatcccagcactttgggaggctgagggcaggagaattgcttgaagccagaagtttgagaccagcctgggcaatgtagtgagaccccctgtctctaaaaaatataaataaaaataaaggcatgttcctgaaagactgtcaccttggaaagtgacaggccctggcattagcatgttgacacacccttttcttcttactcagcaaaatacttcgttttggtttcttcttgtgttgctattgagaaatttgtctgatcatatccttctgcctttgtcccccaagaaatgccctactttatccttttctttttgtagttgaggagggctagagaatcacaattaaaagtaaggaaatagcagggttttgaggatccttgtcccagccccaaagctgaggaaataagaataaatgcttaatatagccttaattctagagcgcaccagccatgaggctgcttttcttgttgtttttgatttttaaaacatacagctgtctggccaggagcatctaccatttctagattattcagagtaatgaggggaatggatggattgctccagtccacagatgagccacataatatgcaaatcatatacccattcatagcatttgttaacattgcttccctgctcagctgctgattgaattctgtgtgcttatataaattatgtcaaaaattatactgcataattgaggtgacagctgttgctgcagtgacatgacagactggaacaatgaagcttttggtttaagtcagccaggaaaatccttctgaatggtaatgtgattgggcaagagctcataaaccatacctcaagtgggtgggagttttatctctatattccttctctctctgaaggaattaaaggcctagatcaagtgctggataattgacaattgcttgtacttaatctgatcggtatctaaaagaaggaaaggatggtcaggaaacatttatcataaatgtagccaaggatatcaattagggtagacaagaataggacaaaaataggccagagctcctgaggaggtgatatgggtctcttgatttgcagaaaatgacagcctatccaagtggcccagtgtatgcctcccagtagcagtgggcatgtaaactgcagcgaccttatttttaaaaccaaaaacctagtatgtggacaaagaacatgacaatatttggtactgagattggttctgagaaacctggggcatgtggctgctgtggttataggtaatatttaagacattcataaaaatctgatattcttttaccgaaataaccccagtatcatctactacttaccatctgttaatagactttactctgtcttttttgtcttcggtttattgtactgagtgccgccaaaacaacttttgttctcttcctgcctacctgcagctggttctataggaatgtagggagccagaggccagtattgatttcagcccttagcacaaaggaaatcagatgcctgcttccagcatttgttagtgttgagtagatgttcttgccctagaagaattacagcctcaaacagaaacctgtttcatggagctttctcccctcagaagagttaatagttaagagctaagcactcttaaacacctaagtctcaaatgctaaaaatttatttttcttgtgtttagtcctctttcaagacatctttctaagcctttcagtaatcaacattaaaagatctccctttcttcagagttatagcacagctttgcccagtagaggctaccaaggacagcttagcagccctttgattgctgggctgggcagatggccttcaagttaagatcaaatgccgggaaaatcagcctacatgggagcacccattttaaacctggagagaaccatgatgttttcttcttcaaataacaatctagttttttttcccccagtactaaaattgtattgtctttcagacaatataatttttatttaaaattggaacatactatcttcatgctttctaagctaaatcttcatttagatttcactcctcagtagatcccagagaagaagctatataggatccagattcaaatttaacagtgtcttctacttttttagttatgttttctatcaactcctgctgccttttcaaatacggatatttttcaggagactcttctacttgtccactgactgtattttttcctttttgatccgtagccctggttaaatggctgacatccttccgtggatgattcttggaggtagtctcagaattccaaagtgattgtctgtcttcttcttgtcttgatcctaatgcagacattcacctctattatttatttattttttttagacagagtctcgctctgtcaccaggctggagtgcagtggcacaatcttggcttactgtaccctccacctcctgggttcaagcgattctcctgcctcagcctctcgagtagctgggactacaggtgtgtgccaccatgcccagctaatttttgtatttttggtagagatggggttttaccatgtttgccaggatggtctcgatttcctgaccttgtgatctgcccaccttggcctcccaaagtgctggaattacaggcatgagccaccgtgcctggccacctctattaaatttttgtggacaaaaataaaattgtcattatttgtttgctctcatggagcactttcagtaatacaattttttttaaattccagttgccctctttgttgctctgtcctctgtaatacctgactttgctaaagacttgaggggtggtttcagaggagggtcaggtgatgggaaggcaggatgagaaaagccctggacttgcatgtttgagaaggcttccaaccacatcttcactcagactcttggaattcctgtccccaaaacaagcttctgttttttgctcacaatgctatatttctaaatttttcctgaattactgagaagcagtcattagctttgttaagtttggtttggggacattgttggtatcaaaaatcgaagtcttattcatttgatgtaggccatgaatcatcaataactggttgctggaaagcttgactaccatccactggggtgctattttgagaaggatttttgggtatctttatagtctgcaattagttgatgattgctttctagtttatcaactgcatttatatttgcttttctgttcatggaaaatcctttatttgctggggttttttgtttgtttgtttgtttttcccacttacagcaagtaaaagtggtctgaggttatccttgtttttcttcgcggtttgccatgtgtgaaagtagatttcctgctattgatatattctcattatagacagaatagtggagaacagtgttgccatggacaaaatccagttttggtccactctggggagcatttggacctgtggtgcttctaacaattaaaagtctagatggtccttgactgtcccccagccatactgcatactactttgtgcattctactttgtgtcattaatgaaagattggttctgtccctgtaacttaggcatttattattcttaactcttcattcctgttctgtagccacccagcagtccattttccctatgttcaggccaaaccacagggcattggggaaggtttttgggattttcttattgagattttgttgaatctgtagtttaccccagctttcctaaggtacagtgaggggttggagggatctgtgtttggcccggggagcaattgtctctaccttaaggttcagttttgagggcataaaatactactttgcaatgtcatgagaacaccattagatctgaaatgtggaaatggtttctcacaatttaaaggaaaaacccactttgcacccatgatcccatcattttggttgagattttagaataaaaaatatagtgttgagatccgtacttttgtaatcagaccaccaagcatgcctgtggcaaggcagagaggaaaggtctggagccagtgtattgcagtttcatgctacctttacctgctaatcataaaaattatgttttcaaaagtagatgatactagccttacacccaaaaacatgttctgaattagatgccccctcacccaatttttattaagctttctaaattccagccacattgctgtacatcaacattggtttcattcaacagacatttttttggcctgaagatacaaggttcagaaagaggccatccctgccctcaaataactttcatactggtgtatgatgaactgaccattaatagtttaagtgcttacaagctatgtttctgttcaaaaaaaaaatagtttggtataataaatgctataaaccaatacacatttctgacttgggggcagagacagactggctgatgttgtatagtttgtagccctggagtaagaagttgacattaatttcggcctatatgtggaaaagacctataacattgggtgaactgagccagctggccatagaacacaagaacatattccaggaaataaatatagctggagggttggaaatgctgttattactgagagagaaaacaggtgagttgggattgagaactcctgattttcatccctggtttagattcttggccaaagtagtggtagagttaatctttgcttgtggaaagcattaactatgttgcagattcagttgtgttacattattgtgggttctataacaacatattcctcatggacactttaccagagttgctcacacctttttcaatttctcatcccttttggaggaatgaacatgagacttaactgcctttaagcctaaaacggacatgctttccaatgacaagagattttctaaagagaagtcttggagcacatctgttaatacctgagcatctactctgagcagtgcagttttattcaatactggagagagggtgatttctttttttttgagacggagtcttgctctgtctcccaggctggagtgcagtggcgcaatctcggctcactgcaagctccacctcccgggttcacgccattctcctgcctcagcctcccgaggagctgggactacaggcgccggccaccacgcccggctaattttttgtatttttagtagagacggggtttcaccttgttagccaggatggtctcaatctcctgacctcatgatccacccacctcggcctcccagagtgctgggattacaggcgtgagccaccgccgggccgagagggtgatttctaagcagagaattgtatcagttatgtggaaacctttgccagaaatacatataccttgtatattaaatctgagtctcagatttaatcatcgaagcgtagctgggttaagaaacagtctgatcgtaaggatgttgtcgattctgacccatggatgaccacaagaaaaagatatttatttctgcctggataattgagagttgactaactttggaagtcagaattcccaggaattagagtaactgctctggaaagttaaagtgtgaagttttttagatagtttcataaaaacaattctggtttctttttgcttgtgctgactttcttggattttaatctacctcatcttgtctttttagagttacttcaacttgtcactttaacattgtgcttgactttggttgttttctaagatggaatttttcctgttcattgacagcttgttctcttgccttttcattctgatcctcatttcatctaacatcatctcatattgctcctctgtcaagagaaatgttttaaaatagtttaaagtcttgttttatgggaagaaagtgatcctccaatgctatttgtttctgaggtcagtaagagaaggagttaaaacaaggcagtggggaagggaatgaatcctgcactggaggcaaaagctgacaaggaaagagccattaattaagacaatttcaaagtcaactgattgtgatcattaatgtcacaatagatcaaaacctaattatcacagcctaggtaagagccatcagtattaatcggaaaatctaataggaaactattatcaagaaattaggccaaattgaatgcagtgaactttttatcttggcattctctatttttttgtgatgtcccctggcattggcaggtgtgaccctaacagtcgattcaaggccaagtggtcagtttgtcagccttttttaagggatttctttttatttttaggaattccaaacagagttaacctaaactgtcattgccaaaagatcagtcttaaactttcttagcacctgtacctgtttaatgtgatcagctatcagtgaggaaaaaaaaaaaaatctatttaggtcttggaatggttcctgtacctagagtatccatattga

SEQ ID NO: 72420 - DNA, 6419 bp, Homo sapiens
agatggggtttcaccatgttggccaggctggtcttgaactcctgagcttgtgattcgcctgccttggcctcccaaagtgctgagattacaggcgtgacagcacccggccacagtatctttattacagctcactgcagcctcaatctgctgagggcaggagaattgcttgaagccagaagtttgagaccagcctgggcaatgtagtgagaccccctgtctctaaaaaatataaataaaaataaaggcatgttcctgaaagactgtcaccttggaaagtgacaggccctggcattagcatgttgacacacccttttcttcttactcagcaaaatacttcgttttggtttcttcttgtgttgctattgagaaatttgtctgatcatatccttctgcctttgtcccccaagaaatgccctactttatccttttctttttgtagttgaggagggctagagaatcacaattaaaagtaaggaaatagcagggttttgaggatccttgtcccagccccaaagctgaggaaataagaataaatgcttaatatagccttaattctagagcgcaccagccatgaggctgcttttcttgttgtttttgatttttaaaacatacagctgtctggccaggagcatctaccatttctagattattcagagtaatgaggggaatggatggattgctccagtccacagatgagccacataatatgcaaatcatatacccattcatagcatttgttaacattgcttccctgctcagctgctgattgaattctgtgtgcttatataaattatgtcaaaaattatactgcataattgaggtgacagctgttgctgcagtgacatgacagactggaacaatgaagcttttggtttaagtcagccaggaaaatccttctgaatggtaatgtgattgggcaagagctcataaaccatacctcaagtgggtgggagttttatctctatattccttctctctctgaaggaattaaaggcctagatcaagtgctggataattgacaattgcttgtacttaatctgatcggtatctaaaagaaggaaaggatggtcaggaaacatttatcataaatgtagccaaggatatcaattagggtagacaagaataggacaaaaataggccagagctcctgaggaggtgatatgggtctcttgatttgcagaaaatgacagcctatccaagtggcccagtgtatgcctcccagtagcagtgggcatgtaaactgcagcgaccttatttttaaaaccaaaaacctagtatgtggacaaagaacatgacaatatttggtactgagattggttctgagaaacctggggcatgtggctgctgtggttataggtaatatttaagacattcataaaaatctgatattcttttaccgaaataaccccagtatcatctactacttaccatctgttaatagactttactctgtcttttttgtcttcggtttattgtactgagtgccgccaaaacaacttttgttctcttcctgcctacctgcagctggttctataggaatgtagggagccagaggccagtattgatttcagcccttagcacaaaggaaatcagatgcctgcttccagcatttgttagtgttgagtagatgttcttgccctagaagaattacagcctcaaacagaaacctgtttcatggagctttctcccctcagaagagttaatagttaagagctaagcactcttaaacacctaagtctcaaatgctaaaaatttatttttcttgtgtttagtcctctttcaagacatctttctaagcctttcagtaatcaacattaaaagatctccctttcttcagagttatagcacagctttgcccagtagaggctaccaaggacagcttagcagccctttgattgctgggctgggcagatggccttcaagttaagatcaaatgccgggaaaatcagcctacatgggagcacccattttaaacctggagagaaccatgatgttttcttcttcaaataacaatctagttttttttcccccagtactaaaattgtattgtctttcagacaatataatttttatttaaaattggaacatactatcttcatgctttctaagctaaatcttcatttagatttcactcctcagtagatcccagagaagaagctatataggatccagattcaaatttaacagtgtcttctacttttttagttatgttttctatcaactcctgctgccttttcaaatacggatatttttcaggagactcttctacttgtccactgactgtattttttcctttttgatccgtagccctggttaaatggctgacatccttccgtggatgattcttggaggtagtctcagaattccaaagtgattgtctgtcttcttcttgtcttgatcctaatgcagacattcacctctattatttatttattttttttagacagagtctcgctctgtcaccaggctggagtgcagtggcacaatcttggcttactgtaccctccacctcctgggttcaagcgattctcctgcctcagcctctcgagtagctgggactacaggtgtgtgccaccatgcccagctaatttttgtatttttggtagagatggggttttaccatgtttgccaggatggtctcgatttcctgaccttgtgatctgcccaccttggcctcccaaagtgctggaattacaggcatgagccaccgtgcctggccacctctattaaatttttgtggacaaaaataaaattgtcattatttgtttgctctcatggagcactttcagtaatacaattttttttaaattccagttgccctctttgttgctctgtcctctgtaatacctgactttgctaaagacttgaggggtggtttcagaggagggtcaggtgatgggaaggcaggatgagaaaagccctggacttgcatgtttgagaaggcttccaaccacatcttcactcagactcttggaattcctgtccccaaaacaagcttctgttttttgctcacaatgctatatttctaaatttttcctgaattactgagaagcagtcattagctttgttaagtttggtttggggacattgttggtatcaaaaatcgaagtcttattcatttgatgtaggccatgaatcatcaataactggttgctggaaagcttgactaccatccactggggtgctattttgagaaggatttttgggtatctttatagtctgcaattagttgatgattgctttctagtttatcaactgcatttatatttgcttttctgttcatggaaaatcctttatttgctggggttttttgtttgtttgtttgtttttcccacttacagcaagtaaaagtggtctgaggttatccttgtttttcttcgcggtttgccatgtgtgaaagtagatttcctgctattgatatattctcattatagacagaatagtggagaacagtgttgccatggacaaaatccagttttggtccactctggggagcatttggacctgtggtgcttctaacaattaaaagtctagatggtccttgactgtcccccagccatactgcatactactttgtgcattctactttgtgtcattaatgaaagattggttctgtccctgtaacttaggcatttattattcttaactcttcattcctgttctgtagccacccagcagtccattttccctatgttcaggccaaaccacagggcattggggaaggtttttgggattttcttattgagattttgttgaatctgtagtttaccccagctttcctaaggtacagtgaggggttggagggatctgtgtttggcccggggagcaattgtctctaccttaaggttcagttttgagggcataaaatactactttgcaatgtcatgagaacaccattagatctgaaatgtggaaatggtttctcacaatttaaaggaaaaacccactttgcacccatgatcccatcattttggttgagattttagaataaaaaatatagtgttgagatccgtacttttgtaatcagaccaccaagcatgcctgtggcaaggcagagaggaaaggtctggagccagtgtattgcagtttcatgctacctttacctgctaatcataaaaattatgttttcaaaagtagatgatactagccttacacccaaaaacatgttctgaattagatgccccctcacccaatttttattaagctttctaaattccagccacattgctgtacatcaacattggtttcattcaacagacatttttttggcctgaagatacaaggttcagaaagaggccatccctgccctcaaataactttcatactggtgtatgatgaactgaccattaatagtttaagtgcttacaagctatgtttctgttcaaaaaaaaaatagtttggtataataaatgctataaaccaatacacatttctgacttgggggcagagacagactggctgatgttgtatagtttgtagccctggagtaagaagttgacattaatttcggcctatatgtggaaaagacctataacattgggtgaactgagccagctggccatagaacacaagaacatattccaggaaataaatatagctggagggttggaaatgctgttattactgagagagaaaacaggtgagttgggattgagaactcctgattttcatccctggtttagattcttggccaaagtagtggtagagttaatctttgcttgtggaaagcattaactatgttgcagattcagttgtgttacattattgtgggttctataacaacatattcctcatggacactttaccagagttgctcacacctttttcaatttctcatcccttttggaggaatgaacatgagacttaactgcctttaagcctaaaacggacatgctttccaatgacaagagattttctaaagagaagtcttggagcacatctgttaatacctgagcatctactctgagcagtgcagttttattcaatactggagagagggtgatttctttttttttgagacggagtcttgctctgtctcccaggctggagtgcagtggcgcaatctcggctcactgcaagctccacctcccgggttcacgccattctcctgcctcagcctcccgaggagctgggactacaggcgccggccaccacgcccggctaattttttgtatttttagtagagacggggtttcaccttgttagccaggatggtctcaatctcctgacctcatgatccacccacctcggcctcccagagtgctgggattacaggcgtgagccaccgccgggccgagagggtgatttctaagcagagaattgtatcagttatgtggaaacctttgccagaaatacatataccttgtatattaaatctgagtctcagatttaatcatcgaagcgtagctgggttaagaaacagtctgatcgtaaggatgttgtcgattctgacccatggatgaccacaagaaaaagatatttatttctgcctggataattgagagttgactaactttggaagtcagaattcccaggaattagagtaactgctctggaaagttaaagtgtgaagttttttagatagtttcataaaaacaattctggtttctttttgcttgtgctgactttcttggattttaatctacctcatcttgtctttttagagttacttcaacttgtcactttaacattgtgcttgactttggttgttttctaagatggaatttttcctgttcattgacagcttgttctcttgccttttcattctgatcctcatttcatctaacatcatctcatattgctcctctgtcaagagaaatgttttaaaatagtttaaagtcttgttttatgggaagaaagtgatcctccaatgctatttgtttctgaggtcagtaagagaaggagttaaaacaaggcagtggggaagggaatgaatcctgcactggaggcaaaagctgacaaggaaagagccattaattaagacaatttcaaagtcaactgattgtgatcattaatgtcacaatagatcaaaacctaattatcacagcctaggtaagagccatcagtattaatcggaaaatctaataggaaactattatcaagaaattaggccaaattgaatgcagtgaactttttatcttggcattctctatttttttgtgatgtcccctggcattggcaggtgtgaccctaacagtcgattcaaggccaagtggtcagtttgtcagccttttttaagggatttctttttatttttaggaattccaaacagagttaacctaaactgtcattgccaaaagatcagtcttaaactttcttagcacctgtacctgtttaatgtgatcagctatcagtgaggaaaaaaaaaaaaatctatttaggtcttggaatggttcctgtacctagagtatccatattga

SEQ ID NO: 72421 - DNA, 6416 bp, Homo sapiens
gatcacttgaggtcaggagttcgagaccagcctggccaacatggtgaaaccccgtctctactaaaaatacaaaattagcccagcctggtggtgcatgcctgtaatcccaagcagctgggactacaggcgcacaccacggtgtctggctaattttattatttaaaaaatgttttgtagagacagtctccctgggcaatgtagtgagaccccctgtctctaaaaaatataaataaaaataaaggcatgttcctgaaagactgtcaccttggaaagtgacaggccctggcattagcatgttgacacacccttttcttcttactcagcaaaatacttcgttttggtttcttcttgtgttgctattgagaaatttgtctgatcatatccttctgcctttgtcccccaagaaatgccctactttatccttttctttttgtagttgaggagggctagagaatcacaattaaaagtaaggaaatagcagggttttgaggatccttgtcccagccccaaagctgaggaaataagaataaatgcttaatatagccttaattctagagcgcaccagccatgaggctgcttttcttgttgtttttgatttttaaaacatacagctgtctggccaggagcatctaccatttctagattattcagagtaatgaggggaatggatggattgctccagtccacagatgagccacataatatgcaaatcatatacccattcatagcatttgttaacattgcttccctgctcagctgctgattgaattctgtgtgcttatataaattatgtcaaaaattatactgcataattgaggtgacagctgttgctgcagtgacatgacagactggaacaatgaagcttttggtttaagtcagccaggaaaatccttctgaatggtaatgtgattgggcaagagctcataaaccatacctcaagtgggtgggagttttatctctatattccttctctctctgaaggaattaaaggcctagatcaagtgctggataattgacaattgcttgtacttaatctgatcggtatctaaaagaaggaaaggatggtcaggaaacatttatcataaatgtagccaaggatatcaattagggtagacaagaataggacaaaaataggccagagctcctgaggaggtgatatgggtctcttgatttgcagaaaatgacagcctatccaagtggcccagtgtatgcctcccagtagcagtgggcatgtaaactgcagcgaccttatttttaaaaccaaaaacctagtatgtggacaaagaacatgacaatatttggtactgagattggttctgagaaacctggggcatgtggctgctgtggttataggtaatatttaagacattcataaaaatctgatattcttttaccgaaataaccccagtatcatctactacttaccatctgttaatagactttactctgtcttttttgtcttcggtttattgtactgagtgccgccaaaacaacttttgttctcttcctgcctacctgcagctggttctataggaatgtagggagccagaggccagtattgatttcagcccttagcacaaaggaaatcagatgcctgcttccagcatttgttagtgttgagtagatgttcttgccctagaagaattacagcctcaaacagaaacctgtttcatggagctttctcccctcagaagagttaatagttaagagctaagcactcttaaacacctaagtctcaaatgctaaaaatttatttttcttgtgtttagtcctctttcaagacatctttctaagcctttcagtaatcaacattaaaagatctccctttcttcagagttatagcacagctttgcccagtagaggctaccaaggacagcttagcagccctttgattgctgggctgggcagatggccttcaagttaagatcaaatgccgggaaaatcagcctacatgggagcacccattttaaacctggagagaaccatgatgttttcttcttcaaataacaatctagttttttttcccccagtactaaaattgtattgtctttcagacaatataatttttatttaaaattggaacatactatcttcatgctttctaagctaaatcttcatttagatttcactcctcagtagatcccagagaagaagctatataggatccagattcaaatttaacagtgtcttctacttttttagttatgttttctatcaactcctgctgccttttcaaatacggatatttttcaggagactcttctacttgtccactgactgtattttttcctttttgatccgtagccctggttaaatggctgacatccttccgtggatgattcttggaggtagtctcagaattccaaagtgattgtctgtcttcttcttgtcttgatcctaatgcagacattcacctctattatttatttattttttttagacagagtctcgctctgtcaccaggctggagtgcagtggcacaatcttggcttactgtaccctccacctcctgggttcaagcgattctcctgcctcagcctctcgagtagctgggactacaggtgtgtgccaccatgcccagctaatttttgtatttttggtagagatggggttttaccatgtttgccaggatggtctcgatttcctgaccttgtgatctgcccaccttggcctcccaaagtgctggaattacaggcatgagccaccgtgcctggccacctctattaaatttttgtggacaaaaataaaattgtcattatttgtttgctctcatggagcactttcagtaatacaattttttttaaattccagttgccctctttgttgctctgtcctctgtaatacctgactttgctaaagacttgaggggtggtttcagaggagggtcaggtgatgggaaggcaggatgagaaaagccctggacttgcatgtttgagaaggcttccaaccacatcttcactcagactcttggaattcctgtccccaaaacaagcttctgttttttgctcacaatgctatatttctaaatttttcctgaattactgagaagcagtcattagctttgttaagtttggtttggggacattgttggtatcaaaaatcgaagtcttattcatttgatgtaggccatgaatcatcaataactggttgctggaaagcttgactaccatccactggggtgctattttgagaaggatttttgggtatctttatagtctgcaattagttgatgattgctttctagtttatcaactgcatttatatttgcttttctgttcatggaaaatcctttatttgctggggttttttgtttgtttgtttgtttttcccacttacagcaagtaaaagtggtctgaggttatccttgtttttcttcgcggtttgccatgtgtgaaagtagatttcctgctattgatatattctcattatagacagaatagtggagaacagtgttgccatggacaaaatccagttttggtccactctggggagcatttggacctgtggtgcttctaacaattaaaagtctagatggtccttgactgtcccccagccatactgcatactactttgtgcattctactttgtgtcattaatgaaagattggttctgtccctgtaacttaggcatttattattcttaactcttcattcctgttctgtagccacccagcagtccattttccctatgttcaggccaaaccacagggcattggggaaggtttttgggattttcttattgagattttgttgaatctgtagtttaccccagctttcctaaggtacagtgaggggttggagggatctgtgtttggcccggggagcaattgtctctaccttaaggttcagttttgagggcataaaatactactttgcaatgtcatgagaacaccattagatctgaaatgtggaaatggtttctcacaatttaaaggaaaaacccactttgcacccatgatcccatcattttggttgagattttagaataaaaaatatagtgttgagatccgtacttttgtaatcagaccaccaagcatgcctgtggcaaggcagagaggaaaggtctggagccagtgtattgcagtttcatgctacctttacctgctaatcataaaaattatgttttcaaaagtagatgatactagccttacacccaaaaacatgttctgaattagatgccccctcacccaatttttattaagctttctaaattccagccacattgctgtacatcaacattggtttcattcaacagacatttttttggcctgaagatacaaggttcagaaagaggccatccctgccctcaaataactttcatactggtgtatgatgaactgaccattaatagtttaagtgcttacaagctatgtttctgttcaaaaaaaaaatagtttggtataataaatgctataaaccaatacacatttctgacttgggggcagagacagactggctgatgttgtatagtttgtagccctggagtaagaagttgacattaatttcggcctatatgtggaaaagacctataacattgggtgaactgagccagctggccatagaacacaagaacatattccaggaaataaatatagctggagggttggaaatgctgttattactgagagagaaaacaggtgagttgggattgagaactcctgattttcatccctggtttagattcttggccaaagtagtggtagagttaatctttgcttgtggaaagcattaactatgttgcagattcagttgtgttacattattgtgggttctataacaacatattcctcatggacactttaccagagttgctcacacctttttcaatttctcatcccttttggaggaatgaacatgagacttaactgcctttaagcctaaaacggacatgctttccaatgacaagagattttctaaagagaagtcttggagcacatctgttaatacctgagcatctactctgagcagtgcagttttattcaatactggagagagggtgatttctttttttttgagacggagtcttgctctgtctcccaggctggagtgcagtggcgcaatctcggctcactgcaagctccacctcccgggttcacgccattctcctgcctcagcctcccgaggagctgggactacaggcgccggccaccacgcccggctaattttttgtatttttagtagagacggggtttcaccttgttagccaggatggtctcaatctcctgacctcatgatccacccacctcggcctcccagagtgctgggattacaggcgtgagccaccgccgggccgagagggtgatttctaagcagagaattgtatcagttatgtggaaacctttgccagaaatacatataccttgtatattaaatctgagtctcagatttaatcatcgaagcgtagctgggttaagaaacagtctgatcgtaaggatgttgtcgattctgacccatggatgaccacaagaaaaagatatttatttctgcctggataattgagagttgactaactttggaagtcagaattcccaggaattagagtaactgctctggaaagttaaagtgtgaagttttttagatagtttcataaaaacaattctggtttctttttgcttgtgctgactttcttggattttaatctacctcatcttgtctttttagagttacttcaacttgtcactttaacattgtgcttgactttggttgttttctaagatggaatttttcctgttcattgacagcttgttctcttgccttttcattctgatcctcatttcatctaacatcatctcatattgctcctctgtcaagagaaatgttttaaaatagtttaaagtcttgttttatgggaagaaagtgatcctccaatgctatttgtttctgaggtcagtaagagaaggagttaaaacaaggcagtggggaagggaatgaatcctgcactggaggcaaaagctgacaaggaaagagccattaattaagacaatttcaaagtcaactgattgtgatcattaatgtcacaatagatcaaaacctaattatcacagcctaggtaagagccatcagtattaatcggaaaatctaataggaaactattatcaagaaattaggccaaattgaatgcagtgaactttttatcttggcattctctatttttttgtgatgtcccctggcattggcaggtgtgaccctaacagtcgattcaaggccaagtggtcagtttgtcagccttttttaagggatttctttttatttttaggaattccaaacagagttaacctaaactgtcattgccaaaagatcagtcttaaactttcttagcacctgtacctgtttaatgtgatcagctatcagtgaggaaaaaaaaaaaaatctatttaggtcttggaatggttcctgtacctagagtatccatattga

SEQ ID NO: 72422 - DNA, 892 bp, Homo sapiens
cagggaaggatccgttttggcgggcggttggcgttgcgcagaaggcggcggcggtggtggcttgtggtgcggcctcaccatacaggaacagggcagacgttagcgtgagtgatcactctcaatcccggggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgaggagcacaatacttgggaacctgagaaaaacttggattgccctgagctaatttctgaatttatgaaaaagtataagaagatgaaggagggtgaaaataataaacccagggagaagtcagaaagtaacaagaggaaatccaatttctcaaacagtgccgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagctaaaggaggggatggtctctgtcatttctctttgtacataatacattcacctccctgcctcctctcctttctacccacccctttctatcctaaacacatccataaaaaatgtgcttatcaccggtcttatctcaatccgggatcctcta

SEQ ID NO: 72423 - DNA, 7849 bp, Homo sapiens
agaggggtaccatacatgtgtgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagctaaaggaggggatggtctctgtcatttctctttgtacataatacattcacctccctgcctcctctcctttctacccacccctttctatcctaaacacatccataaaaaatgtgcttatcactgtgctccacaggagaaatgttggtattggttctcttgtaacataactgatggtctgattaatgataagtgtctctctgtgaagaccaggcatttacatactgagtgtaatacccacaatttttttttcctttgccctgatctcttccttctgcttccctgtgacctcaagatgagtttcaactttttaatcaccttagagtcttgatcttttcagggttggtcgctttttaggttgggggattttgttacaatgatgttgaattttggtttcttgctttggttcttagaacatgttgctgactagctggcctttgttctgacatgttgagatggaaaggatgttgcccatctgttaaaaagccaatagcaactgcctacctgttggggctttcccaaccttgttcagctctacccaggagaatacagggtttctggtgtggtcttctgggccaccctctgttgttcatcctcactcatcctcccagaattactccatcctttggaagatttgaaattttacactgaaatctgtcaagacactctttttagccccaggactttcggtattgcttttagcactccccacttctgcttctgtaaagtgatatcaatttgtgataaaatgacaagattattaactgtgcagatttgtagctatagtacatgaggatgatggggtagggtacaattgtctttattatcatatatggtatgtatgtatgatttctttccattcctcatatttagactgtatatttatgtaggtgtgagtgattgcctggtgcttgcttgtgccaaggtgctaggcaccctccaaccctgccaacttttgtggcctcccaaagcattcctgttaccaaagaggcttcaaacctgaccctcacttctcagtggacccgagtttcccttccatgccattattttcagtggggaagttttagaggtgagctgttggccacaatatcaattttaagtgttcatagcagttatgtctcctgcattcttggctcctggatttaccaccaagagtccccaaaatattaatgctcttccctttttctaccctcaaacttatagttgtatcttattttttaaaatgaattttcatggccaggcacagtggctaccgcctgtaatcccagcactttgggaggctgagggcaggagaattgcttgaagccagaagtttgagaccagcctgggcaatgtagtgagaccccctgtctctaaaaaatataaataaaaataaaggcatgttcctgaaagactgtcaccttggaaagtgacaggccctggcattagcatgttgacacacccttttcttcttactcagcaaaatacttcgttttggtttcttcttgtgttgctattgagaaatttgtctgatcatatccttctgcctttgtcccccaagaaatgccctactttatccttttctttttgtagttgaggagggctagagaatcacaattaaaagtaaggaaatagcagggttttgaggatccttgtcccagccccaaagctgaggaaataagaataaatgcttaatatagccttaattctagagcgcaccagccatgaggctgcttttcttgttgtttttgatttttaaaacatacagctgtctggccaggagcatctaccatttctagattattcagagtaatgaggggaatggatggattgctccagtccacagatgagccacataatatgcaaatcatatacccattcatagcatttgttaacattgcttccctgctcagctgctgattgaattctgtgtgcttatataaattatgtcaaaaattatactgcataattgaggtgacagctgttgctgcagtgacatgacagactggaacaatgaagcttttggtttaagtcagccaggaaaatccttctgaatggtaatgtgattgggcaagagctcataaaccatacctcaagtgggtgggagttttatctctatattccttctctctctgaaggaattaaaggcctagatcaagtgctggataattgacaattgcttgtacttaatctgatcggtatctaaaagaaggaaaggatggtcaggaaacatttatcataaatgtagccaaggatatcaattagggtagacaagaataggacaaaaataggccagagctcctgaggaggtgatatgggtctcttgatttgcagaaaatgacagcctatccaagtggcccagtgtatgcctcccagtagcagtgggcatgtaaactgcagcgaccttatttttaaaaccaaaaacctagtatgtggacaaagaacatgacaatatttggtactgagattggttctgagaaacctggggcatgtggctgctgtggttataggtaatatttaagacattcataaaaatctgatattcttttaccgaaataaccccagtatcatctactacttaccatctgttaatagactttactctgtcttttttgtcttcggtttattgtactgagtgccgccaaaacaacttttgttctcttcctgcctacctgcagctggttctataggaatgtagggagccagaggccagtattgatttcagcccttagcacaaaggaaatcagatgcctgcttccagcatttgttagtgttgagtagatgttcttgccctagaagaattacagcctcaaacagaaacctgtttcatggagctttctcccctcagaagagttaatagttaagagctaagcactcttaaacacctaagtctcaaatgctaaaaatttatttttcttgtgtttagtcctctttcaagacatctttctaagcctttcagtaatcaacattaaaagatctccctttcttcagagttatagcacagctttgcccagtagaggctaccaaggacagcttagcagccctttgattgctgggctgggcagatggccttcaagttaagatcaaatgccgggaaaatcagcctacatgggagcacccattttaaacctggagagaaccatgatgttttcttcttcaaataacaatctagttttttttcccccagtactaaaattgtattgtctttcagacaatataatttttatttaaaattggaacatactatcttcatgctttctaagctaaatcttcatttagatttcactcctcagtagatcccagagaagaagctatataggatccagattcaaatttaacagtgtcttctacttttttagttatgttttctatcaactcctgctgccttttcaaatacggatatttttcaggagactcttctacttgtccactgactgtattttttcctttttgatccgtagccctggttaaatggctgacatccttccgtggatgattcttggaggtagtctcagaattccaaagtgattgtctgtcttcttcttgtcttgatcctaatgcagacattcacctctattatttatttattttttttagacagagtctcgctctgtcaccaggctggagtgcagtggcacaatcttggcttactgtaccctccacctcctgggttcaagcgattctcctgcctcagcctctcgagtagctgggactacaggtgtgtgccaccatgcccagctaatttttgtatttttggtagagatggggttttaccatgtttgccaggatggtctcgatttcctgaccttgtgatctgcccaccttggcctcccaaagtgctggaattacaggcatgagccaccgtgcctggccacctctattaaatttttgtggacaaaaataaaattgtcattatttgtttgctctcatggagcactttcagtaatacaattttttttaaattccagttgccctctttgttgctctgtcctctgtaatacctgactttgctaaagacttgaggggtggtttcagaggagggtcaggtgatgggaaggcaggatgagaaaagccctggacttgcatgtttgagaaggcttccaaccacatcttcactcagactcttggaattcctgtccccaaaacaagcttctgttttttgctcacaatgctatatttctaaatttttcctgaattactgagaagcagtcattagctttgttaagtttggtttggggacattgttggtatcaaaaatcgaagtcttattcatttgatgtaggccatgaatcatcaataactggttgctggaaagcttgactaccatccactggggtgctattttgagaaggatttttgggtatctttatagtctgcaattagttgatgattgctttctagtttatcaactgcatttatatttgcttttctgttcatggaaaatcctttatttgctggggttttttgtttgtttgtttgtttttcccacttacagcaagtaaaagtggtctgaggttatccttgtttttcttcgcggtttgccatgtgtgaaagtagatttcctgctattgatatattctcattatagacagaatagtggagaacagtgttgccatggacaaaatccagttttggtccactctggggagcatttggacctgtggtgcttctaacaattaaaagtctagatggtccttgactgtcccccagccatactgcatactactttgtgcattctactttgtgtcattaatgaaagattggttctgtccctgtaacttaggcatttattattcttaactcttcattcctgttctgtagccacccagcagtccattttccctatgttcaggccaaaccacagggcattggggaaggtttttgggattttcttattgagattttgttgaatctgtagtttaccccagctttcctaaggtacagtgaggggttggagggatctgtgtttggcccggggagcaattgtctctaccttaaggttcagttttgagggcataaaatactactttgcaatgtcatgagaacaccattagatctgaaatgtggaaatggtttctcacaatttaaaggaaaaacccactttgcacccatgatcccatcattttggttgagattttagaataaaaaatatagtgttgagatccgtacttttgtaatcagaccaccaagcatgcctgtggcaaggcagagaggaaaggtctggagccagtgtattgcagtttcatgctacctttacctgctaatcataaaaattatgttttcaaaagtagatgatactagccttacacccaaaaacatgttctgaattagatgccccctcacccaatttttattaagctttctaaattccagccacattgctgtacatcaacattggtttcattcaacagacatttttttggcctgaagatacaaggttcagaaagaggccatccctgccctcaaataactttcatactggtgtatgatgaactgaccattaatagtttaagtgcttacaagctatgtttctgttcaaaaaaaaaatagtttggtataataaatgctataaaccaatacacatttctgacttgggggcagagacagactggctgatgttgtatagtttgtagccctggagtaagaagttgacattaatttcggcctatatgtggaaaagacctataacattgggtgaactgagccagctggccatagaacacaagaacatattccaggaaataaatatagctggagggttggaaatgctgttattactgagagagaaaacaggtgagttgggattgagaactcctgattttcatccctggtttagattcttggccaaagtagtggtagagttaatctttgcttgtggaaagcattaactatgttgcagattcagttgtgttacattattgtgggttctataacaacatattcctcatggacactttaccagagttgctcacacctttttcaatttctcatcccttttggaggaatgaacatgagacttaactgcctttaagcctaaaacggacatgctttccaatgacaagagattttctaaagagaagtcttggagcacatctgttaatacctgagcatctactctgagcagtgcagttttattcaatactggagagagggtgatttctttttttttgagacggagtcttgctctgtctcccaggctggagtgcagtggcgcaatctcggctcactgcaagctccacctcccgggttcacgccattctcctgcctcagcctcccgaggagctgggactacaggcgccggccaccacgcccggctaattttttgtatttttagtagagacggggtttcaccttgttagccaggatggtctcaatctcctgacctcatgatccacccacctcggcctcccagagtgctgggattacaggcgtgagccaccgccgggccgagagggtgatttctaagcagagaattgtatcagttatgtggaaacctttgccagaaatacatataccttgtatattaaatctgagtctcagatttaatcatcgaagcgtagctgggttaagaaacagtctgatcgtaaggatgttgtcgattctgacccatggatgaccacaagaaaaagatatttatttctgcctggataattgagagttgactaactttggaagtcagaattcccaggaattagagtaactgctctggaaagttaaagtgtgaagttttttagatagtttcataaaaacaattctggtttctttttgcttgtgctgactttcttggattttaatctacctcatcttgtctttttagagttacttcaacttgtcactttaacattgtgcttgactttggttgttttctaagatggaatttttcctgttcattgacagcttgttctcttgccttttcattctgatcctcatttcatctaacatcatctcatattgctcctctgtcaagagaaatgttttaaaatagtttaaagtcttgttttatgggaagaaagtgatcctccaatgctatttgtttctgaggtcagtaagagaaggagttaaaacaaggcagtggggaagggaatgaatcctgcactggaggcaaaagctgacaaggaaagagccattaattaagacaatttcaaagtcaactgattgtgatcattaatgtcacaatagatcaaaacctaattatcacagcctaggtaagagccatcagtattaatcggaaaatctaataggaaactattatcaagaaattaggccaaattgaatgcagtgaactttttatcttggcattctctatttttttgtgatgtcccctggcattggcaggtgtgaccctaacagtcgattcaaggccaagtggtcagtttgtcagccttttttaagggatttctttttatttttaggaattccaaacagagttaacctaaactgtcattgccaaaagatcagtcttaaactttcttagcacctgtacctgtttaatgtgatcagctatcagtgaggaaaaaaaaaaaaatctatttaggtcttggaatggttcctgtacctagagtatccatattga

SEQ ID NO: 72424 - DNA, 8068 bp, Homo sapiens
cagggaaggatccgttttggcgggcggttggcgttgcgcagaaggcggcggcggtggtggcttgtggtgcggcctcaccatacaggaacagggcagacgttagcgtgagtgatcactctcaatcccggggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgatggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagctaaaggaggggatggtctctgtcatttctctttgtacataatacattcacctccctgcctcctctcctttctacccacccctttctatcctaaacacatccataaaaaatgtgcttatcactgtgctccacaggagaaatgttggtattggttctcttgtaacataactgatggtctgattaatgataagtgtctctctgtgaagaccaggcatttacatactgagtgtaatacccacaatttttttttcctttgccctgatctcttccttctgcttccctgtgacctcaagatgagtttcaactttttaatcaccttagagtcttgatcttttcagggttggtcgctttttaggttgggggattttgttacaatgatgttgaattttggtttcttgctttggttcttagaacatgttgctgactagctggcctttgttctgacatgttgagatggaaaggatgttgcccatctgttaaaaagccaatagcaactgcctacctgttggggctttcccaaccttgttcagctctacccaggagaatacagggtttctggtgtggtcttctgggccaccctctgttgttcatcctcactcatcctcccagaattactccatcctttggaagatttgaaattttacactgaaatctgtcaagacactctttttagccccaggactttcggtattgcttttagcactccccacttctgcttctgtaaagtgatatcaatttgtgataaaatgacaagattattaactgtgcagatttgtagctatagtacatgaggatgatggggtagggtacaattgtctttattatcatatatggtatgtatgtatgatttctttccattcctcatatttagactgtatatttatgtaggtgtgagtgattgcctggtgcttgcttgtgccaaggtgctaggcaccctccaaccctgccaacttttgtggcctcccaaagcattcctgttaccaaagaggcttcaaacctgaccctcacttctcagtggacccgagtttcccttccatgccattattttcagtggggaagttttagaggtgagctgttggccacaatatcaattttaagtgttcatagcagttatgtctcctgcattcttggctcctggatttaccaccaagagtccccaaaatattaatgctcttccctttttctaccctcaaacttatagttgtatcttattttttaaaatgaattttcatggccaggcacagtggctaccgcctgtaatcccagcactttgggaggctgagggcaggagaattgcttgaagccagaagtttgagaccagcctgggcaatgtagtgagaccccctgtctctaaaaaatataaataaaaataaaggcatgttcctgaaagactgtcaccttggaaagtgacaggccctggcattagcatgttgacacacccttttcttcttactcagcaaaatacttcgttttggtttcttcttgtgttgctattgagaaatttgtctgatcatatccttctgcctttgtcccccaagaaatgccctactttatccttttctttttgtagttgaggagggctagagaatcacaattaaaagtaaggaaatagcagggttttgaggatccttgtcccagccccaaagctgaggaaataagaataaatgcttaatatagccttaattctagagcgcaccagccatgaggctgcttttcttgttgtttttgatttttaaaacatacagctgtctggccaggagcatctaccatttctagattattcagagtaatgaggggaatggatggattgctccagtccacagatgagccacataatatgcaaatcatatacccattcatagcatttgttaacattgcttccctgctcagctgctgattgaattctgtgtgcttatataaattatgtcaaaaattatactgcataattgaggtgacagctgttgctgcagtgacatgacagactggaacaatgaagcttttggtttaagtcagccaggaaaatccttctgaatggtaatgtgattgggcaagagctcataaaccatacctcaagtgggtgggagttttatctctatattccttctctctctgaaggaattaaaggcctagatcaagtgctggataattgacaattgcttgtacttaatctgatcggtatctaaaagaaggaaaggatggtcaggaaacatttatcataaatgtagccaaggatatcaattagggtagacaagaataggacaaaaataggccagagctcctgaggaggtgatatgggtctcttgatttgcagaaaatgacagcctatccaagtggcccagtgtatgcctcccagtagcagtgggcatgtaaactgcagcgaccttatttttaaaaccaaaaacctagtatgtggacaaagaacatgacaatatttggtactgagattggttctgagaaacctggggcatgtggctgctgtggttataggtaatatttaagacattcataaaaatctgatattcttttaccgaaataaccccagtatcatctactacttaccatctgttaatagactttactctgtcttttttgtcttcggtttattgtactgagtgccgccaaaacaacttttgttctcttcctgcctacctgcagctggttctataggaatgtagggagccagaggccagtattgatttcagcccttagcacaaaggaaatcagatgcctgcttccagcatttgttagtgttgagtagatgttcttgccctagaagaattacagcctcaaacagaaacctgtttcatggagctttctcccctcagaagagttaatagttaagagctaagcactcttaaacacctaagtctcaaatgctaaaaatttatttttcttgtgtttagtcctctttcaagacatctttctaagcctttcagtaatcaacattaaaagatctccctttcttcagagttatagcacagctttgcccagtagaggctaccaaggacagcttagcagccctttgattgctgggctgggcagatggccttcaagttaagatcaaatgccgggaaaatcagcctacatgggagcacccattttaaacctggagagaaccatgatgttttcttcttcaaataacaatctagttttttttcccccagtactaaaattgtattgtctttcagacaatataatttttatttaaaattggaacatactatcttcatgctttctaagctaaatcttcatttagatttcactcctcagtagatcccagagaagaagctatataggatccagattcaaatttaacagtgtcttctacttttttagttatgttttctatcaactcctgctgccttttcaaatacggatatttttcaggagactcttctacttgtccactgactgtattttttcctttttgatccgtagccctggttaaatggctgacatccttccgtggatgattcttggaggtagtctcagaattccaaagtgattgtctgtcttcttcttgtcttgatcctaatgcagacattcacctctattatttatttattttttttagacagagtctcgctctgtcaccaggctggagtgcagtggcacaatcttggcttactgtaccctccacctcctgggttcaagcgattctcctgcctcagcctctcgagtagctgggactacaggtgtgtgccaccatgcccagctaatttttgtatttttggtagagatggggttttaccatgtttgccaggatggtctcgatttcctgaccttgtgatctgcccaccttggcctcccaaagtgctggaattacaggcatgagccaccgtgcctggccacctctattaaatttttgtggacaaaaataaaattgtcattatttgtttgctctcatggagcactttcagtaatacaattttttttaaattccagttgccctctttgttgctctgtcctctgtaatacctgactttgctaaagacttgaggggtggtttcagaggagggtcaggtgatgggaaggcaggatgagaaaagccctggacttgcatgtttgagaaggcttccaaccacatcttcactcagactcttggaattcctgtccccaaaacaagcttctgttttttgctcacaatgctatatttctaaatttttcctgaattactgagaagcagtcattagctttgttaagtttggtttggggacattgttggtatcaaaaatcgaagtcttattcatttgatgtaggccatgaatcatcaataactggttgctggaaagcttgactaccatccactggggtgctattttgagaaggatttttgggtatctttatagtctgcaattagttgatgattgctttctagtttatcaactgcatttatatttgcttttctgttcatggaaaatcctttatttgctggggttttttgtttgtttgtttgtttttcccacttacagcaagtaaaagtggtctgaggttatccttgtttttcttcgcggtttgccatgtgtgaaagtagatttcctgctattgatatattctcattatagacagaatagtggagaacagtgttgccatggacaaaatccagttttggtccactctggggagcatttggacctgtggtgcttctaacaattaaaagtctagatggtccttgactgtcccccagccatactgcatactactttgtgcattctactttgtgtcattaatgaaagattggttctgtccctgtaacttaggcatttattattcttaactcttcattcctgttctgtagccacccagcagtccattttccctatgttcaggccaaaccacagggcattggggaaggtttttgggattttcttattgagattttgttgaatctgtagtttaccccagctttcctaaggtacagtgaggggttggagggatctgtgtttggcccggggagcaattgtctctaccttaaggttcagttttgagggcataaaatactactttgcaatgtcatgagaacaccattagatctgaaatgtggaaatggtttctcacaatttaaaggaaaaacccactttgcacccatgatcccatcattttggttgagattttagaataaaaaatatagtgttgagatccgtacttttgtaatcagaccaccaagcatgcctgtggcaaggcagagaggaaaggtctggagccagtgtattgcagtttcatgctacctttacctgctaatcataaaaattatgttttcaaaagtagatgatactagccttacacccaaaaacatgttctgaattagatgccccctcacccaatttttattaagctttctaaattccagccacattgctgtacatcaacattggtttcattcaacagacatttttttggcctgaagatacaaggttcagaaagaggccatccctgccctcaaataactttcatactggtgtatgatgaactgaccattaatagtttaagtgcttacaagctatgtttctgttcaaaaaaaaaatagtttggtataataaatgctataaaccaatacacatttctgacttgggggcagagacagactggctgatgttgtatagtttgtagccctggagtaagaagttgacattaatttcggcctatatgtggaaaagacctataacattgggtgaactgagccagctggccatagaacacaagaacatattccaggaaataaatatagctggagggttggaaatgctgttattactgagagagaaaacaggtgagttgggattgagaactcctgattttcatccctggtttagattcttggccaaagtagtggtagagttaatctttgcttgtggaaagcattaactatgttgcagattcagttgtgttacattattgtgggttctataacaacatattcctcatggacactttaccagagttgctcacacctttttcaatttctcatcccttttggaggaatgaacatgagacttaactgcctttaagcctaaaacggacatgctttccaatgacaagagattttctaaagagaagtcttggagcacatctgttaatacctgagcatctactctgagcagtgcagttttattcaatactggagagagggtgatttctttttttttgagacggagtcttgctctgtctcccaggctggagtgcagtggcgcaatctcggctcactgcaagctccacctcccgggttcacgccattctcctgcctcagcctcccgaggagctgggactacaggcgccggccaccacgcccggctaattttttgtatttttagtagagacggggtttcaccttgttagccaggatggtctcaatctcctgacctcatgatccacccacctcggcctcccagagtgctgggattacaggcgtgagccaccgccgggccgagagggtgatttctaagcagagaattgtatcagttatgtggaaacctttgccagaaatacatataccttgtatattaaatctgagtctcagatttaatcatcgaagcgtagctgggttaagaaacagtctgatcgtaaggatgttgtcgattctgacccatggatgaccacaagaaaaagatatttatttctgcctggataattgagagttgactaactttggaagtcagaattcccaggaattagagtaactgctctggaaagttaaagtgtgaagttttttagatagtttcataaaaacaattctggtttctttttgcttgtgctgactttcttggattttaatctacctcatcttgtctttttagagttacttcaacttgtcactttaacattgtgcttgactttggttgttttctaagatggaatttttcctgttcattgacagcttgttctcttgccttttcattctgatcctcatttcatctaacatcatctcatattgctcctctgtcaagagaaatgttttaaaatagtttaaagtcttgttttatgggaagaaagtgatcctccaatgctatttgtttctgaggtcagtaagagaaggagttaaaacaaggcagtggggaagggaatgaatcctgcactggaggcaaaagctgacaaggaaagagccattaattaagacaatttcaaagtcaactgattgtgatcattaatgtcacaatagatcaaaacctaattatcacagcctaggtaagagccatcagtattaatcggaaaatctaataggaaactattatcaagaaattaggccaaattgaatgcagtgaactttttatcttggcattctctatttttttgtgatgtcccctggcattggcaggtgtgaccctaacagtcgattcaaggccaagtggtcagtttgtcagccttttttaagggatttctttttatttttaggaattccaaacagagttaacctaaactgtcattgccaaaagatcagtcttaaactttcttagcacctgtacctgtttaatgtgatcagctatcagtgaggaaaaaaaaaaaaatctatttaggtcttggaatggttcctgtacctagagtatccatattga

SEQ ID NO: 72425 - DNA, 7690 bp, Homo sapiens
cagggaaggatccgttttggcgggcggttggcgttgcgcagaaggcggcggcggtggtggcttgtggtgcggcctcaccatacaggaacagggcagacgttagcgtgagtgatcactctcaatcccggggacctggtggccttagtctttcaggtggaacggtgtgcgacatgggaaagaaaaccaagcggacagctgacagttctcctttctacccacccctttctatcctaaacacatccataaaaaatgtgcttatcactgtgctccacaggagaaatgttggtattggttctcttgtaacataactgatggtctgattaatgataagtgtctctctgtgaagaccaggcatttacatactgagtgtaatacccacaatttttttttcctttgccctgatctcttccttctgcttccctgtgacctcaagatgagtttcaactttttaatcaccttagagtcttgatcttttcagggttggtcgctttttaggttgggggattttgttacaatgatgttgaattttggtttcttgctttggttcttagaacatgttgctgactagctggcctttgttctgacatgttgagatggaaaggatgttgcccatctgttaaaaagccaatagcaactgcctacctgttggggctttcccaaccttgttcagctctacccaggagaatacagggtttctggtgtggtcttctgggccaccctctgttgttcatcctcactcatcctcccagaattactccatcctttggaagatttgaaattttacactgaaatctgtcaagacactctttttagccccaggactttcggtattgcttttagcactccccacttctgcttctgtaaagtgatatcaatttgtgataaaatgacaagattattaactgtgcagatttgtagctatagtacatgaggatgatggggtagggtacaattgtctttattatcatatatggtatgtatgtatgatttctttccattcctcatatttagactgtatatttatgtaggtgtgagtgattgcctggtgcttgcttgtgccaaggtgctaggcaccctccaaccctgccaacttttgtggcctcccaaagcattcctgttaccaaagaggcttcaaacctgaccctcacttctcagtggacccgagtttcccttccatgccattattttcagtggggaagttttagaggtgagctgttggccacaatatcaattttaagtgttcatagcagttatgtctcctgcattcttggctcctggatttaccaccaagagtccccaaaatattaatgctcttccctttttctaccctcaaacttatagttgtatcttattttttaaaatgaattttcatggccaggcacagtggctaccgcctgtaatcccagcactttgggaggctgagggcaggagaattgcttgaagccagaagtttgagaccagcctgggcaatgtagtgagaccccctgtctctaaaaaatataaataaaaataaaggcatgttcctgaaagactgtcaccttggaaagtgacaggccctggcattagcatgttgacacacccttttcttcttactcagcaaaatacttcgttttggtttcttcttgtgttgctattgagaaatttgtctgatcatatccttctgcctttgtcccccaagaaatgccctactttatccttttctttttgtagttgaggagggctagagaatcacaattaaaagtaaggaaatagcagggttttgaggatccttgtcccagccccaaagctgaggaaataagaataaatgcttaatatagccttaattctagagcgcaccagccatgaggctgcttttcttgttgtttttgatttttaaaacatacagctgtctggccaggagcatctaccatttctagattattcagagtaatgaggggaatggatggattgctccagtccacagatgagccacataatatgcaaatcatatacccattcatagcatttgttaacattgcttccctgctcagctgctgattgaattctgtgtgcttatataaattatgtcaaaaattatactgcataattgaggtgacagctgttgctgcagtgacatgacagactggaacaatgaagcttttggtttaagtcagccaggaaaatccttctgaatggtaatgtgattgggcaagagctcataaaccatacctcaagtgggtgggagttttatctctatattccttctctctctgaaggaattaaaggcctagatcaagtgctggataattgacaattgcttgtacttaatctgatcggtatctaaaagaaggaaaggatggtcaggaaacatttatcataaatgtagccaaggatatcaattagggtagacaagaataggacaaaaataggccagagctcctgaggaggtgatatgggtctcttgatttgcagaaaatgacagcctatccaagtggcccagtgtatgcctcccagtagcagtgggcatgtaaactgcagcgaccttatttttaaaaccaaaaacctagtatgtggacaaagaacatgacaatatttggtactgagattggttctgagaaacctggggcatgtggctgctgtggttataggtaatatttaagacattcataaaaatctgatattcttttaccgaaataaccccagtatcatctactacttaccatctgttaatagactttactctgtcttttttgtcttcggtttattgtactgagtgccgccaaaacaacttttgttctcttcctgcctacctgcagctggttctataggaatgtagggagccagaggccagtattgatttcagcccttagcacaaaggaaatcagatgcctgcttccagcatttgttagtgttgagtagatgttcttgccctagaagaattacagcctcaaacagaaacctgtttcatggagctttctcccctcagaagagttaatagttaagagctaagcactcttaaacacctaagtctcaaatgctaaaaatttatttttcttgtgtttagtcctctttcaagacatctttctaagcctttcagtaatcaacattaaaagatctccctttcttcagagttatagcacagctttgcccagtagaggctaccaaggacagcttagcagccctttgattgctgggctgggcagatggccttcaagttaagatcaaatgccgggaaaatcagcctacatgggagcacccattttaaacctggagagaaccatgatgttttcttcttcaaataacaatctagttttttttcccccagtactaaaattgtattgtctttcagacaatataatttttatttaaaattggaacatactatcttcatgctttctaagctaaatcttcatttagatttcactcctcagtagatcccagagaagaagctatataggatccagattcaaatttaacagtgtcttctacttttttagttatgttttctatcaactcctgctgccttttcaaatacggatatttttcaggagactcttctacttgtccactgactgtattttttcctttttgatccgtagccctggttaaatggctgacatccttccgtggatgattcttggaggtagtctcagaattccaaagtgattgtctgtcttcttcttgtcttgatcctaatgcagacattcacctctattatttatttattttttttagacagagtctcgctctgtcaccaggctggagtgcagtggcacaatcttggcttactgtaccctccacctcctgggttcaagcgattctcctgcctcagcctctcgagtagctgggactacaggtgtgtgccaccatgcccagctaatttttgtatttttggtagagatggggttttaccatgtttgccaggatggtctcgatttcctgaccttgtgatctgcccaccttggcctcccaaagtgctggaattacaggcatgagccaccgtgcctggccacctctattaaatttttgtggacaaaaataaaattgtcattatttgtttgctctcatggagcactttcagtaatacaattttttttaaattccagttgccctctttgttgctctgtcctctgtaatacctgactttgctaaagacttgaggggtggtttcagaggagggtcaggtgatgggaaggcaggatgagaaaagccctggacttgcatgtttgagaaggcttccaaccacatcttcactcagactcttggaattcctgtccccaaaacaagcttctgttttttgctcacaatgctatatttctaaatttttcctgaattactgagaagcagtcattagctttgttaagtttggtttggggacattgttggtatcaaaaatcgaagtcttattcatttgatgtaggccatgaatcatcaataactggttgctggaaagcttgactaccatccactggggtgctattttgagaaggatttttgggtatctttatagtctgcaattagttgatgattgctttctagtttatcaactgcatttatatttgcttttctgttcatggaaaatcctttatttgctggggttttttgtttgtttgtttgtttttcccacttacagcaagtaaaagtggtctgaggttatccttgtttttcttcgcggtttgccatgtgtgaaagtagatttcctgctattgatatattctcattatagacagaatagtggagaacagtgttgccatggacaaaatccagttttggtccactctggggagcatttggacctgtggtgcttctaacaattaaaagtctagatggtccttgactgtcccccagccatactgcatactactttgtgcattctactttgtgtcattaatgaaagattggttctgtccctgtaacttaggcatttattattcttaactcttcattcctgttctgtagccacccagcagtccattttccctatgttcaggccaaaccacagggcattggggaaggtttttgggattttcttattgagattttgttgaatctgtagtttaccccagctttcctaaggtacagtgaggggttggagggatctgtgtttggcccggggagcaattgtctctaccttaaggttcagttttgagggcataaaatactactttgcaatgtcatgagaacaccattagatctgaaatgtggaaatggtttctcacaatttaaaggaaaaacccactttgcacccatgatcccatcattttggttgagattttagaataaaaaatatagtgttgagatccgtacttttgtaatcagaccaccaagcatgcctgtggcaaggcagagaggaaaggtctggagccagtgtattgcagtttcatgctacctttacctgctaatcataaaaattatgttttcaaaagtagatgatactagccttacacccaaaaacatgttctgaattagatgccccctcacccaatttttattaagctttctaaattccagccacattgctgtacatcaacattggtttcattcaacagacatttttttggcctgaagatacaaggttcagaaagaggccatccctgccctcaaataactttcatactggtgtatgatgaactgaccattaatagtttaagtgcttacaagctatgtttctgttcaaaaaaaaaatagtttggtataataaatgctataaaccaatacacatttctgacttgggggcagagacagactggctgatgttgtatagtttgtagccctggagtaagaagttgacattaatttcggcctatatgtggaaaagacctataacattgggtgaactgagccagctggccatagaacacaagaacatattccaggaaataaatatagctggagggttggaaatgctgttattactgagagagaaaacaggtgagttgggattgagaactcctgattttcatccctggtttagattcttggccaaagtagtggtagagttaatctttgcttgtggaaagcattaactatgttgcagattcagttgtgttacattattgtgggttctataacaacatattcctcatggacactttaccagagttgctcacacctttttcaatttctcatcccttttggaggaatgaacatgagacttaactgcctttaagcctaaaacggacatgctttccaatgacaagagattttctaaagagaagtcttggagcacatctgttaatacctgagcatctactctgagcagtgcagttttattcaatactggagagagggtgatttctttttttttgagacggagtcttgctctgtctcccaggctggagtgcagtggcgcaatctcggctcactgcaagctccacctcccgggttcacgccattctcctgcctcagcctcccgaggagctgggactacaggcgccggccaccacgcccggctaattttttgtatttttagtagagacggggtttcaccttgttagccaggatggtctcaatctcctgacctcatgatccacccacctcggcctcccagagtgctgggattacaggcgtgagccaccgccgggccgagagggtgatttctaagcagagaattgtatcagttatgtggaaacctttgccagaaatacatataccttgtatattaaatctgagtctcagatttaatcatcgaagcgtagctgggttaagaaacagtctgatcgtaaggatgttgtcgattctgacccatggatgaccacaagaaaaagatatttatttctgcctggataattgagagttgactaactttggaagtcagaattcccaggaattagagtaactgctctggaaagttaaagtgtgaagttttttagatagtttcataaaaacaattctggtttctttttgcttgtgctgactttcttggattttaatctacctcatcttgtctttttagagttacttcaacttgtcactttaacattgtgcttgactttggttgttttctaagatggaatttttcctgttcattgacagcttgttctcttgccttttcattctgatcctcatttcatctaacatcatctcatattgctcctctgtcaagagaaatgttttaaaatagtttaaagtcttgttttatgggaagaaagtgatcctccaatgctatttgtttctgaggtcagtaagagaaggagttaaaacaaggcagtggggaagggaatgaatcctgcactggaggcaaaagctgacaaggaaagagccattaattaagacaatttcaaagtcaactgattgtgatcattaatgtcacaatagatcaaaacctaattatcacagcctaggtaagagccatcagtattaatcggaaaatctaataggaaactattatcaagaaattaggccaaattgaatgcagtgaactttttatcttggcattctctatttttttgtgatgtcccctggcattggcaggtgtgaccctaacagtcgattcaaggccaagtggtcagtttgtcagccttttttaagggatttctttttatttttaggaattccaaacagagttaacctaaactgtcattgccaaaagatcagtcttaaactttcttagcacctgtacctgtttaatgtgatcagctatcagtgaggaaaaaaaaaaaaatctatttaggtcttggaatggttcctgtacctagagtatccatattga

SEQ ID NO: 72426 - DNA, 5237 bp, Homo sapiens
cagggaaggatccgttttggcgggcggttggcgttgcgcagaaggcggcggcggtggtggcttgtggtgcggcctcaccatacaggaacagggcagacgttagcgtgagtgatcactctcaatcccggggacctggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgaggagcacaatacttgggaacctgagaaaaacttggattgccctgagctaatttctgaatttatgaaaaagtataagaagatgaaggagggtgaaaataataaacccagggagaagtcagaaagtaacaagaggaaatccaatttctcaaacagtgccgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagctaaaggaggggatggtctctgtcatttctctttgtacataatacattcacctccctgcctcctctcctttctacccacccctttctatcctaaacacatccataaaaaatgtgcttatcactgtgctccacaggagaaatgttggtattggttctcttgtaacataactgatggtctgattaatgataagtgtctctctgtgaagaccaggcatttacatactgagtgtaatacccacaatttttttttcctttgccctgatctcttccttctgcttccctgtgacctcaagatgagtttcaactttttaatcaccttagagtcttgatcttttcagggttggtcgctttttaggttgggggattttgttacaatgatgttgaattttggtttcttgctttggttcttagaacatgttgctgactagctggcctttgttctgacatgttgagatggaaaggatgttgcccatctgttaaaaagccaatagcaactgcctacctgttggggctttcccaaccttgttcagctctacccaggagaatacagggtttctggtgtggtcttctgggccaccctctgttgttcatcctcactcatcctcccagaattactccatcctttggaagatttgaaattttacactgaaatctgtcaagacactctttttagccccaggactttcggtattgcttttagcactccccacttctgcttctgtaaagtgatatcaatttgtgataaaatgacaagattattaactgtgcagatttgtagctatagtacatgaggatgatggggtagggtacaattgtctttattatcatatatggtatgtatgtatgatttctttccattcctcatatttagactgtatatttatgtaggtgtgagtgattgcctggtgcttgcttgtgccaaggtgctaggcaccctccaaccctgccaacttttgtggcctcccaaagcattcctgttaccaaagaggcttcaaacctgaccctcacttctcagtggacccgagtttcccttccatgccattattttcagtggggaagttttagaggtgagctgttggccacaatatcaattttaagtgttcatagcagttatgtctcctgcattcttggctcctggatttaccaccaagagtccccaaaatattaatgctcttccctttttctaccctcaaacttatagttgtatcttattttttaaaatgaattttcatggccaggcacagtggctaccgcctgtaatcccagcactttgggaggctgagggcaggagaattgcttgaagccagaagtttgagaccagcctgggcaatgtagtgagaccccctgtctctaaaaaatataaataaaaataaaggcatgttcctgaaagactgtcaccttggaaagtgacaggccctggcattagcatgttgacacacccttttcttcttactcagcaaaatacttcgttttggtttcttcttgtgttgctattgagaaatttgtctgatcatatccttctgcctttgtcccccaagaaatgccctactttatccttttctttttgtagttgaggagggctagagaatcacaattaaaagtaaggaaatagcagggttttgaggatccttgtcccagccccaaagctgaggaaataagaataaatgcttaatatagccttaattctagagcgcaccagccatgaggctgcttttcttgttgtttttgatttttaaaacatacagctgtctggccaggagcatctaccatttctagattattcagagtaatgaggggaatggatggattgctccagtccacagatgagccacataatatgcaaatcatatacccattcatagcatttgttaacattgcttccctgctcagctgctgattgaattctgtgtgcttatataaattatgtcaaaaattatactgcataattgaggtgacagctgttgctgcagtgacatgacagactggaacaatgaagcttttggtttaagtcagccaggaaaatccttctgaatggtaatgtgattgggcaagagctcataaaccatacctcaagtgggtgggagttttatctctatattccttctctctctgaaggaattaaaggcctagatcaagtgctggataattgacaattgcttgtacttaatctgatcggtatctaaaagaaggaaaggatggtcaggaaacatttatcataaatgtagccaaggatatcaattagggtagacaagaataggacaaaaataggccagagctcctgaggaggtgatatgggtctcttgatttgcagaaaatgacagcctatccaagtggcccagtgtatgcctcccagtagcagtgggcatgtaaactgcagcgaccttatttttaaaaccaaaaacctagtatgtggacaaagaacatgacaatatttggtactgagattggttctgagaaacctggggcatgtggctgctgtggttataggtaatatttaagacattcataaaaatctgatattcttttaccgaaataaccccagtatcatctactacttaccatctgttaatagactttactctgtcttttttgtcttcggtttattgtactgagtgccgccaaaacaacttttgttctcttcctgcctacctgcagctggttctataggaatgtagggagccagaggccagtattgatttcagcccttagcacaaaggaaatcagatgcctgcttccagcatttgttagtgttgagtagatgttcttgccctagaagaattacagcctcaaacagaaacctgtttcatggagctttctcccctcagaagagttaatagttaagagctaagcactcttaaacacctaagtctcaaatgctaaaaatttatttttcttgtgtttagtcctctttcaagacatctttctaagcctttcagtaatcaacattaaaagatctccctttcttcagagttatagcacagctttgcccagtagaggctaccaaggacagcttagcagccctttgattgctgggctgggcagatggccttcaagttaagatcaaatgccgggaaaatcagcctacatgggagcacccattttaaacctggagagaaccatgatgttttcttcttcaaataacaatctagttttttttcccccagtactaaaattgtattgtctttcagacaatataatttttatttaaaattggaacatactatcttcatgctttctaagctaaatcttcatttagatttcactcctcagtagatcccagagaagaagctatataggatccagattcaaatttaacagtgtcttctacttttttagttatgttttctatcaactcctgctgccttttcaaatacggatatttttcaggagactcttctacttgtccactgactgtattttttcctttttgatccgtagccctggttaaatggctgacatccttccgtggatgattcttggaggtagtctcagaattccaaagtgattgtctgtcttcttcttgtcttgatcctaatgcagacattcacctctattatttatttattttttttagacagagtctcgctctgtcaccaggctggagtgcagtggcacaatcttggcttactgtaccctccacctcctgggttcaagcgattctcctgcctcagcctctcgagtagctgggactacaggtgtgtgccaccatgcccagctaatttttgtatttttggtagagatggggttttaccatgtttgccaggatggtctcgatttcctgaccttgtgatctgcccaccttggcctcccaaagtgctggaattacaggcatgagccaccgtgcctggccacctctattaaatttttgtggacaaaaataaaattgtcattatttgtttgctctcatggagcactttcagtaatacaattttttttaaattccagttgccctctttgttgctctgtcctctgtaatacctgactttgctaaagacttgaggggtggtttcagaggagggtcaggtgatgggaaggcaggatgagaaaagccctggacttgcatgtttgagaaggcttccaaccacatcttcactcagactcttggaattcctgtccccaaaacaagcttctgttttttgctcacaatgctatatttctaaatttttcctgaattactgagaagcagtcattagctttgttaagtttggtttggggacattgttggtatcaaaaatcgaagtcttattcatttgatgtaggccatgaatcatcaataactggttgctggaaagcttgactaccatccactggggtgctattttgagaaggatttttgggtatctttatagtctgcaattagttgatgattgctttctagtttatcaactgcatttatatttgcttttctgttcatggaaaatcctttatttgctggggttttttgtttgtttgtttgtttttcccacttacagcaagtaaaagtggtctgaggtta

SEQ ID NO: 72427 - DNA, 4537 bp, Homo sapiens
aggaggaggagggtgagagagaagctgggagagcagagaaaaggggccaccggtcgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaagcaggcccttctgaaactgatgatgttgatgaaaaacagcccctatcgaagcctttgcaaggaagccaccattcttcagagggcaatgaaggcacagaaatggaagtaccagcagaagattctactcaacatgtcccttcagaaacaagtgaggaccctgaagttgaggtgactattgaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaggaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgcgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaaaaagtcgga

SEQ ID NO: 72428 - DNA, 4477 bp, Homo sapiens
aggaggaggagggtgagagagaagctgggagagcagagaaaaggggccaccggtcgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaagattctactcaacatgtcccttcagaaacaagtgaggaccctgaagttgaggtgactattgaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaggaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgcgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaaaaagtcgga

SEQ ID NO: 72429 - DNA, 3154 bp, Homo sapiens
aggaggaggagggtgagagagaagctgggagagcagagaaaaggggccaccggtcgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagaaataaaagagactgatggaagctctcagatcaagcaagaaccagaccccacgtggtagacctcttccctcctaggcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgcgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaaaaagtcgga

SEQ ID NO: 72430 - DNA, 4414 bp, Homo sapiens
aggaggaggagggtgagagagaagctgggagagcagagaaaaggggccaccggtcgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaggaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgcgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaaaaagtcgga

SEQ ID NO: 72431 - DNA, 4474 bp, Homo sapiens
aggaggaggagggtgagagagaagctgggagagcagagaaaaggggccaccggtcgcccccccgcttccccgcacgcgctctccagccgcggccgcccgcctgccgcggtcaccccggcctctgcctctgtcccccagtgatcggatcaaggcgctgagcgaggccctgcctgcggggcggccatgcggcggtgacaggagcgcgaccgacacgcacgggcccctcgccccctctcgcctcccgtccgctcgccagctcccctcagccgaggctgctccgcggcggccgcagcccgcgcgcggcccacactcgcctcccctcggcacccccggccccggagctgcctggaggcggccgcactcggggatcatggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaagcaggcccttctgaaactgatgatgttgatgaaaaacagcccctatcgaagcctttgcaaggaagccaccattcttcagagggcaatgaaggcacagaaatggaagtaccagcagaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaggaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactaccccaagctgtgtaatatacttgtataacagaaataccttctatacaaacctttttttctacttttagatagaaatgtctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgcgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaaaaagtcgga

SEQ ID NO: 72432 - DNA, 533 bp, Homo sapiens
tattagagatgttgaccgtgttttctacaaattctgattttaaatgtatattttcaggaaaaataaattcatcacccaatgttaatactactgcatcaggtgttgaagaccttaacatcattcaggtgacaattccaggtatgagttctctgcttccatcagagtttttgggggtctcttcagggcctcttggactttcccaactagagaggtttgctcagctcatccggggactcggatacattacacgttgcctggtgctcctcccagactcctacagcagttgccttccaaatacagttgctctccaaacagcaacggcaagttttggcacttggcatgagctaaatcctgttaaccacccaaatggctagtctgttccttaaaaaaagtctatatgagaccgggcacggtggctcacgcctgtaatcccagcactttgggaggctgaggcaggaggatcgcttgaggtcaggaattcaaaaccagcctagccaacgtggtgaaaccctgactctactaaacatacaaga

SEQ ID NO: 72433 - DNA, 514 bp, Homo sapiens
aggtcatataccagttaaactgccccattttgcctcttagtgtacattgtgagcccactcaaccagttcctgagatactactgggaagctgctgatcaccagtttcaggttttttccatctgttgggaaactgcctatcccttgtgctcgctgcaaccaattattattttagggagacagttaaccgcctgaccatcacccgatgatcgcctgatgttcatgcatccatgactacataaactttttggccgtttgaccaaatggggacatctggcatactgctatcaaccaatataaaactactggagggtggttccaagatggccaaataggaacagctccagtctacagctcccagcatgagtgatgcagaagacgaatgatttctgcatttccaactcagttcacagatcttcaactccagagaactgagtttaaggagctgtacctgggaaattgtgcctgaagctgttcctgaggaatctgcacctggatctaatgtacatgctgagat

SEQ ID NO: 72434 - DNA, 799 bp, Homo sapiens
gtgctaaatagccaacagatattagccttcgtttttcttagtgaagagctcataatcaaaagagaaggtaagcacaaagacaaaaacaagacttaaaaactgtttgattcctgttcactgaatgccatttctttcagggtagatttaaggactttccccttaaagtacagtgctactgactctagattgagggttcaagccaccccgtgggttaacttcaacagatgaaaatttttccttggctacagcaacatccctaatcctgaccagccatggagaggttcggttcttacaaggaaaatgagtgaatgtgggaatggctcaccacattgtgaaaacaaaactcacatcctgctgatggttggctgaggactgtcatgtccacatacaaagaaaagcatgtggcacagttttaggacaaaggtgagcagagatccaccgtggaaaggggcatattttcttatagagagaccatccaaggcatgcccctcggtaagcagtgttggtgggtgaccacggtcacacgcatggaggcttgctttcccctgctcctcatacccactccctagcagtttctggtattgagcacccccttagtcgtgccttgcccagttagccattgatcagcctgtttccagagcaagccatgggtattagattgcagacaggacttagtctccctgttcagtgaagatgtttggaatacagaagtgaccctaagctgttctgaaaagagttgaggtaaatcctattcagtagaacataacagagcaaagggcagacttggtgtttgggacca

SEQ ID NO: 72435 - DNA, 479 bp, Homo sapiens
ctgagctgtggccaacgtttgcagaccaggaatccacactagctctaatcagagagcccttggtgtgcgggaactgccagtctgccgacgtgaaaagagtcccagactgggtaatggtgagccctgaagtcgcaccccagctctgccactcagtgagcacggcaacatccctaatcctgaccagccatggagaggttcggttcttacaaggaaaatgagtgaatgtgggaatggctcaccacattgtgaaaacaaaactcacatcctgctgatggttggctgaggactgtcatgtccacatacaaagtctgcgtgatgcagatgatgctgtttatgaactgaatggcaaagacctttgtggtgagcgagtaattgttgagcatgcccgcggcccacggcgagatggcagttacggttctggacgcagtaagcattcaaagggcatacttttatcagtaacgtgcttttgttatcatgct

SEQ ID NO: 72436 - DNA, 143 bp, Homo sapiens
gatcgagctcggtaccactagtccacggttggctagtgaagagctcataatcaaaagagaaggtaagcacaaagacaaaaacaagacttaaaaagctacagaaacatgactgggcacagtggctcacgcctgtaatcccagca

SEQ ID NO: 72437 - DNA, 2305 bp, Homo sapiens
gtgctcgcgtacgtcgccggggttcggctgcgtccgtcccgccgcccgcccgttgccgccgccgccgctgccgccgtgctctcgctttgcccgccgccgcctaaggggggctggggccggggccagccatcactgccgttgccgggatgccgcgggtgtacatcggccgcctgagctaccaggcccgggagcgcgatgtggagcgcttctttaagggctacgggaagatcctggaggtggatctgaagaacggatatggttttgtggagtttgatgatctgcgtgatgcagatgatgctgtttatgaactgaatggcaaagacctttgtggtgagcgagtaattgttgagcatgcccgcggcccacggcgagatggcagttacggttctggacgcagtggatatggttatagaagaagtggccgagataaatatggccctcctactcgcacagagtacagacttattgtggagaatttgtcaagtcggtgcagctggcaagacctaaaggattatatgcgtcaggcaggagaagtgacttatgcagatgctcacaagggacgcaaaaatgaaggggtgattgaatttgtatcttattctgatatgaaaagagctttggaaaagttggatggaactgaagtcaatgggagaaaaatcagattagttgaagacaagccaggttccagacgacgccggtcctactccagaagccggagtcattcaaggtctcgctctcgaagcagacattcccgtaagagcagaagccgaagtggcagcagcaaaagcagtcattctaagagtagatctcggtccaggtcgggctcccgctcccggagcaagagccggagccggagccagagtcggagccggagcaagaaagagaaaagcaggagccccagcaaggacaagagccgcagccgcagccatagcgctggcaagagccgcagcaagagcaaagaccaagctgaagagaagatccaaaacaatgacaatgtcgggaaacccaagagccggagtcctagcaggcataaaagtaagagcaaaagtcggagcaggagtcaggagaggagagtggaggaggagaagcgagggagtgtgagcaggggcaggagccaggagaagagcctccgccagagtcggagccggagcaggagcaaagcgggcagcaggagccggagcaggagccgcagcaagagcaaggacaagaggaagagcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcccgctccgtgtcaaaggagcgggaacatgccaagtctgaatccagccagagggaaggtcgaggagagagtgagaatgctggcaccaatcaggagacccggtccaggtcgagatccaattccaaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaagaaaagaaaagaattttttttaattttatttttccccgtcttgcaaagtatagtgacccctgtttccattaaatttgaataaagactatttttgcttgacaaaaaatcatg

SEQ ID NO: 72438 - DNA, 2466 bp, Homo sapiens
gtgctcgcgtacgtcgccggggttcggctgcgtccgtcccgccgcccgcccgttgccgccgccgccgctgccgccgtgctctcgctttgcccgccgccgcctaaggggggctggggccggggccagccatcactgccgttgccgggatgccgcgggtgtacatcggccgcctgagctaccaggcccgggagcgcgatgtggagcgcttctttaagggctacgggaagatcctggaggtggatctgaagaacggatatggttttgtggagtttgatgatctgcgtgatgcagatgatgctgtttatgaactgaatggcaaagacctttgtggtgagcgagtaattgttgagcatgcccgcggcccacggcgagatggcagttacggttctggacgcagtggatatggttatagaagaagtggccgagataaatatggccctcctactcgcacagagtacagacttattgtggagaatttgtcaagtcggtgcagctggcaagacctaaaggattatatgcgtcaggcaggagaagtgacttatgcagatgctcacaagggacgcaaaaatgaaggggtgattgaatttgtatcttattctgatatgaaaagagctttggaaaagttggatggaactgaagtcaatgggagaaaaatcagattagttgaagacaagccaggttccagacgacgccggtcctactccagaagccggagtcattcaaggtctcgctctcgaagcagacattcccgtaagagcagaagccgaagtggcagcagcaaaagcagtcattctaagagtagatctcggtccaggtcgggctcccgctcccggagcaagagccggagccggagccagagtcggagccggagcaagaaagagaaaagcaggagccccagcaaggacaagagccgcagccgcagccatagcgctggcaagagccgcagcaagagcaaagaccaagctgaagagaagatccaaaacaatgacaatgtcgggaaacccaagagccggagtcctagcaggcataaaagtaagagcaaaagtcggagcaggagtcaggagaggagagtggaggaggagaagcgagggagtgtgagcaggggcaggagccaggagaagagcctccgccagagtcggagccggagcaggagcaaagcgggcagcaggagccggagcaggagccgcagcaagagcaaggacaagaggaagagcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcccgctccgtgtcaaaggagcgggaacatgccaagtctgaatccagccagagggaaggtcgaggagagagtgagaatgctggcaccaatcaggagacccggtccaggtcgagatccaattccaaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaagaaaagaaaagaattttttttaattttatttttccccgtcttgcaaagtatagtgacccctgtttccattaaatttgaataaagataacagcacctactgataggcgttggaacgacaacacaacagagcagaacagacgcgagcacaagcacgcagcgccaacaacaaaacaagcgcgccaccgaccacacagaggaacgacaccacccggggggctcccaacggaagaggcggcgaccccggagaagaagggacaaaaaaggagcgacaa

SEQ ID NO: 72439 - DNA, 2280 bp, Homo sapiens
caggtagaggctgggtttaatcggccgagggcgacgccgccgctgccgccgtgctctcgctttgcccgccgccgcctaaggggggctggggccggggccagccatcactgccgttgccgggatgccgcgggtgtacatcggccgcctgagctaccaggcccgggagcgcgatgtggagcgcttctttaagggctacgggaagatcctggaggtggatctgaagaacggatatggttttgtggagtttgatgatctgcgtgatgcagatgatgctgtttatgaactgaatggcaaagacctttgtggtgagcgagtaattgttgagcatgcccgcggcccacggcgagatggcagttacggttctggacgcagtggatatggttatagaagaagtggccgagataaatatggccctcctactcgcacagagtacagacttattgtggagaatttgtcaagtcggtgcagctggcaagacctaaaggattatatgcgtcaggcaggagaagtgacttatgcagatgctcacaagggacgcaaaaatgaaggggtgattgaatttgtatcttattctgatatgaaaagagctttggaaaagttggatggaactgaagtcaatgggagaaaaatcagattagttgaagacaagccaggttccagacgacgccggtcctactccagaagccggagtcattcaaggtctcgctctcgaagcagacattcccgtaagagcagaagccgaagtggcagcagcaaaagcagtcattctaagagtagatctcggtccaggtcgggctcccgctcccggagcaagagccggagccggagccagagtcggagccggagcaagaaagagaaaagcaggagccccagcaaggacaagagccgcagccgcagccatagcgctggcaagagccgcagcaagagcaaagaccaagctgaagagaagatccaaaacaatgacaatgtcgggaaacccaagagccggagtcctagcaggcataaaagtaagagcaaaagtcggagcaggagtcaggagaggagagtggaggaggagaagcgagggagtgtgagcaggggcaggagccaggagaagagcctccgccagagtcggagccggagcaggagcaaagcgggcagcaggagccggagcaggagccgcagcaagagcaaggacaagaggaagagcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcccgctccgtgtcaaaggagcgggaacatgccaagtctgaatccagccagagggaaggtcgaggagagagtgagaatgctggcaccaatcaggagacccggtccaggtcgagatccaattccaaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaagaaaagaaaagaattttttttaattttatttttccccgtcttgcaaagtatagtgacccctgtttccattaaatttgaataaagactatttttgcttgacaaaaaatcatg

SEQ ID NO: 72440 - DNA, 2389 bp, Homo sapiens
ctgagctgtggccaacgtttgcagaccaggaatccacactagctctaatcagagagcccttggtgtgcgggaactgccagtctgccgacgtgaaaagagtcccagactgggtaatggtgagccctgaagtcgcaccccagctctgccactcagtgagcacggcaacatccctaatcctgaccagccatggagaggttcggttcttacaaggaaaatgagtgaatgtgggaatggctcaccacattgtgaaaacaaaactcacatcctgctgatggttggctgaggactgtcatgtccacatacaaagaaaagcatgtggcacagttttaggacaaagatatggttttgtggagtttgatgatctgcgtgatgcagatgatgctgtttatgaactgaatggcaaagacctttgtggtgagcgagtaattgttgagcatgcccgcggcccacggcgagatggcagttacggttctggacgcagtggatatggttatagaagaagtggccgagataaatatggccctcctactcgcacagagtacagacttattgtggagaatttgtcaagtcggtgcagctggcaagacctaaaggattatatgcgtcaggcaggagaagtgacttatgcagatgctcacaagggacgcaaaaatgaaggggtgattgaatttgtatcttattctgatatgaaaagagctttggaaaagttggatggaactgaagtcaatgggagaaaaatcagattagttgaagacaagccaggttccagacgacgccggtcctactccagaagccggagtcattcaaggtctcgctctcgaagcagacattcccgtaagagcagaagccgaagtggcagcagcaaaagcagtcattctaagagtagatctcggtccaggtcgggctcccgctcccggagcaagagccggagccggagccagagtcggagccggagcaagaaagagaaaagcaggagccccagcaaggacaagagccgcagccgcagccatagcgctggcaagagccgcagcaagagcaaagaccaagctgaagagaagatccaaaacaatgacaatgtcgggaaacccaagagccggagtcctagcaggcataaaagtaagagcaaaagtcggagcaggagtcaggagaggagagtggaggaggagaagcgagggagtgtgagcaggggcaggagccaggagaagagcctccgccagagtcggagccggagcaggagcaaagcgggcagcaggagccggagcaggagccgcagcaagagcaaggacaagaggaagagcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcccgctccgtgtcaaaggagcgggaacatgccaagtctgaatccagccagagggaaggtcgaggagagagtgagaatgctggcaccaatcaggagacccggtccaggtcgagatccaattccaaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaagaaaagaaaagaattttttttaattttatttttccccgtcttgcaaagtatagtgacccctgtttccattaaatttgaataaagactatttttgcttgacaaaaaatcatg

SEQ ID NO: 72441 - DNA, 2162 bp, Homo sapiens
gtgctcgcgtacgtcgccggggttcggctgcgtccgtcccgccgcccgcccgttgccgccgccgccgctgccgccgtgctctcgctttgcccgccgccgcctaaggggggctggggccggggccagccatcactgccgttgccgggatgccgcgggtgtacatcggccgcctgagctaccaggcccgggagcgcgatgtggagcgcttctttaagggctacgggaagatcctggaggtggatctgaagaacgggtggatatggttatagaagaagtggccgagataaatatggccctcctactcgcacagagtacagacttattgtggagaatttgtcaagtcggtgcagctggcaagacctaaaggattatatgcgtcaggcaggagaagtgacttatgcagatgctcacaagggacgcaaaaatgaaggggtgattgaatttgtatcttattctgatatgaaaagagctttggaaaagttggatggaactgaagtcaatgggagaaaaatcagattagttgaagacaagccaggttccagacgacgccggtcctactccagaagccggagtcattcaaggtctcgctctcgaagcagacattcccgtaagagcagaagccgaagtggcagcagcaaaagcagtcattctaagagtagatctcggtccaggtcgggctcccgctcccggagcaagagccggagccggagccagagtcggagccggagcaagaaagagaaaagcaggagccccagcaaggacaagagccgcagccgcagccatagcgctggcaagagccgcagcaagagcaaagaccaagctgaagagaagatccaaaacaatgacaatgtcgggaaacccaagagccggagtcctagcaggcataaaagtaagagcaaaagtcggagcaggagtcaggagaggagagtggaggaggagaagcgagggagtgtgagcaggggcaggagccaggagaagagcctccgccagagtcggagccggagcaggagcaaagcgggcagcaggagccggagcaggagccgcagcaagagcaaggacaagaggaagagcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcccgctccgtgtcaaaggagcgggaacatgccaagtctgaatccagccagagggaaggtcgaggagagagtgagaatgctggcaccaatcaggagacccggtccaggtcgagatccaattccaaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaagaaaagaaaagaattttttttaattttatttttccccgtcttgcaaagtatagtgacccctgtttccattaaatttgaataaagactatttttgcttgacaaaaaatcatg

SEQ ID NO: 72442 - DNA, 1971 bp, Homo sapiens
ctgtgtcattttttttccttttcttccactgaaataatcttatttatttgaaccttccaaaggtggatatggttatagaagaagtggccgagataaatatggccctcctactcgcacagagtacagacttattgtggagaatttgtcaagtcggtgcagctggcaagacctaaaggattatatgcgtcaggcaggagaagtgacttatgcagatgctcacaagggacgcaaaaatgaaggggtgattgaatttgtatcttattctgatatgaaaagagctttggaaaagttggatggaactgaagtcaatgggagaaaaatcagattagttgaagacaagccaggttccagacgacgccggtcctactccagaagccggagtcattcaaggtctcgctctcgaagcagacattcccgtaagagcagaagccgaagtggcagcagcaaaagcagtcattctaagagtagatctcggtccaggtcgggctcccgctcccggagcaagagccggagccggagccagagtcggagccggagcaagaaagagaaaagcaggagccccagcaaggacaagagccgcagccgcagccatagcgctggcaagagccgcagcaagagcaaagaccaagctgaagagaagatccaaaacaatgacaatgtcgggaaacccaagagccggagtcctagcaggcataaaagtaagagcaaaagtcggagcaggagtcaggagaggagagtggaggaggagaagcgagggagtgtgagcaggggcaggagccaggagaagagcctccgccagagtcggagccggagcaggagcaaagcgggcagcaggagccggagcaggagccgcagcaagagcaaggacaagaggaagagcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcccgctccgtgtcaaaggagcgggaacatgccaagtctgaatccagccagagggaaggtcgaggagagagtgagaatgctggcaccaatcaggagacccggtccaggtcgagatccaattccaaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaagaaaagaaaagaattttttttaattttatttttccccgtcttgcaaagtatagtgacccctgtttccattaaatttgaataaagactatttttgcttgacaaaaaatcatg

SEQ ID NO: 72443 - DNA, 2215 bp, Homo sapiens
gtgctcgcgtacgtcgccggggttcggctgcgtccgtcccgccgcccgcccgttgccgccgccgccgctgccgccgtgctctcgctttgcccgccgccgcctaaggggggctggggccggggccagccatcactgccgttgccgggatgccgcgggtgtacatcggccgcctgagctaccaggcccgggagcgcgatgtggagcgcttctttaagggctacgggaagatcctggaggtggatctgaagaacggatatggttttgtggagtttgatgatctgcgtgatgcagatgatgctgtttatgaactgaatggcaaagacctttgtggtgagcgagtaattgttgagcatgcccgcggcccacggcgagatggcagttacggttctggacgcagtggatatggttatagaagaagtggccgagataaatatggccctcctactcgcacagagtacagacttattgtggagaatttgtcaagtcggtgcagctggcaagacctaaaggattatatgcgtcaggcaggagaagtgacttatgcagatgctcacaagggacgcaaaaatgaaggggtgattgaatttgtatcttattctgatatgaaaagagctttggaaaagttggatggaactgaagtcaatgggagaaaaatcagattagttgaagacaagccaggttccagacgacgccggtcctactccagaagccggagtcattcaaggtcgggctcccgctcccggagcaagagccggagccggagccagagtcggagccggagcaagaaagagaaaagcaggagccccagcaaggacaagagccgcagccgcagccatagcgctggcaagagccgcagcaagagcaaagaccaagctgaagagaagatccaaaacaatgacaatgtcgggaaacccaagagccggagtcctagcaggcataaaagtaagagcaaaagtcggagcaggagtcaggagaggagagtggaggaggagaagcgagggagtgtgagcaggggcaggagccaggagaagagcctccgccagagtcggagccggagcaggagcaaagcgggcagcaggagccggagcaggagccgcagcaagagcaaggacaagaggaagagcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcccgctccgtgtcaaaggagcgggaacatgccaagtctgaatccagccagagggaaggtcgaggagagagtgagaatgctggcaccaatcaggagacccggtccaggtcgagatccaattccaaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaagaaaagaaaagaattttttttaattttatttttccccgtcttgcaaagtatagtgacccctgtttccattaaatttgaataaagactatttttgcttgacaaaaaatcatg

SEQ ID NO: 72444 - DNA, 1632 bp, Homo sapiens
aacatgagcagagtgcgaggctggctgcaaatcggccgagggtcgtccaaggtctcgctctcgaagcagacattcccgtaagagcagaagccgaagtggcagcagcaaaagcagtcattctaagagtagatctcggtccaggtcgggctcccgctcccggagcaagagccggagccggagccagagtcggagccggagcaagaaagagaaaagcaggagccccagcaaggacaagagccgcagccgcagccatagcgctggcaagagccgcagcaagagcaaagaccaagctgaagagaagatccaaaacaatgacaatgtcgggaaacccaagagccggagtcctagcaggcataaaagtaagagcaaaagtcggagcaggagtcaggagaggagagtggaggaggagaagcgagggagtgtgagcaggggcaggagccaggagaagagcctccgccagagtcggagccggagcaggagcaaagcgggcagcaggagccggagcaggagccgcagcaagagcaaggacaagaggaagagcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcccgctccgtgtcaaaggagcgggaacatgccaagtctgaatccagccagagggaaggtcgaggagagagtgagaatgctggcaccaatcaggagacccggtccaggtcgagatccaattccaaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaagaaaagaaaagaattttttttaattttatttttccccgtcttgcaaagtatagtgacccctgtttccattaaatttgaataaagactatttttgcttgacaaaaaatcatg

SEQ ID NO: 72445 - DNA, 1881 bp, Homo sapiens
ctgtgtcattttttttccttttcttccactgaaataatcttatttatttgaaccttccaaaggtggatatggttatagaagaagtggccgagataaatatggccctcctactcgcacagagtacagacttattgtggagaatttgtcaagtcggtgcagctggcaagacctaaaggattatatgcgtcaggcaggagaagtgacttatgcagatgctcacaagggacgcaaaaatgaaggggtgattgaatttgtatcttattctgatatgaaaagagctttggaaaagttggatggaactgaagtcaatgggagaaaaatcagattagttgaagacaagccaggttccagacgacgccggtcctactccagaagccggagtcattcaaggtcgggctcccgctcccggagcaagagccggagccggagccagagtcggagccggagcaagaaagagaaaagcaggagccccagcaaggacaagagccgcagccgcagccatagcgctggcaagagccgcagcaagagcaaagaccaagctgaagagaagatccaaaacaatgacaatgtcgggaaacccaagagccggagtcctagcaggcataaaagtaagagcaaaagtcggagcaggagtcaggagaggagagtggaggaggagaagcgagggagtgtgagcaggggcaggagccaggagaagagcctccgccagagtcggagccggagcaggagcaaagcgggcagcaggagccggagcaggagccgcagcaagagcaaggacaagaggaagagcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcccgctccgtgtcaaaggagcgggaacatgccaagtctgaatccagccagagggaaggtcgaggagagagtgagaatgctggcaccaatcaggagacccggtccaggtcgagatccaattccaaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaagaaaagaaaagaattttttttaattttatttttccccgtcttgcaaagtatagtgacccctgtttccattaaatttgaataaagactatttttgcttgacaaaaaatcatg

SEQ ID NO: 72446 - DNA, 1874 bp, Homo sapiens
tcacgggttcaagcgattctcctgcctcagcctcctgagtagctcggtttacaggcgtgtgccagcatgcctggctaatttttggtatttttagtagagacggggcttcaccatgttggccaggctggctcttgaactcctgacctcgcgatccgcctgccttggcctctcaaagtgctgggattatgggcatgagccgccgcacctggccagtttttccagcttctgattggcattgtgagggttcagaaaacaatcctcagccagtgccagccatgctttatattggggggtgtaactccacatgtatgccctttggtctttttatctcctgattagcatgaagtcacatgtgacacaaacagtatcccatgtctcctcaggtcgggctcccgctcccggagcaagagccggagccggagccagagtcggagccggagcaagaaagagaaaagcaggagccccagcaaggacaagagccgcagccgcagccatagcgctggcaagagccgcagcaagagcaaagaccaagctgaagagaagatccaaaacaatgacaatgtcgggaaacccaagagccggagtcctagcaggcataaaagtaagagcaaaagtcggagcaggagtcaggagaggagagtggaggaggagaagcgagggagtgtgagcaggggcaggagccaggagaagagcctccgccagagtcggagccggagcaggagcaaagcgggcagcaggagccggagcaggagccgcagcaagagcaaggacaagaggaagagcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcccgctccgtgtcaaaggagcgggaacatgccaagtctgaatccagccagagggaaggtcgaggagagagtgagaatgctggcaccaatcaggagacccggtccaggtcgagatccaattccaaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaagaaaagaaaagaattttttttaattttatttttccccgtcttgcaaagtatagtgacccctgtttccattaaatttgaataaagactatttttgcttgacaaaaaatcatg

SEQ ID NO: 72447 - DNA, 1820 bp, Homo sapiens
tcacgggttcaagcgattctcctgcctcagcctcctgagtagctcggtttacaggcgtgtgccagcatgcctggctaatttttggtatttttagtagagacggggcttcaccatgttggccaggctggctcttgaactcctgacctcgcgatccgcctgccttggcctctcaaagtgctgggattatgggcatgagccgccgcacctggccagtttttccagcttctgattggcattgtgagggttcagaaaacaatcctcagccagtgccagccatgctttatattggggggtgtaactccacatgtatgccctttggtctttttatctcctgattagcatgaagtcacatgtgacacaaacagtatcccatgtctcctcaggtcgggctcccgctcccggagcaagagccggagccggagccagagtcggagccggagcaagaaagagaaaagcaggagccccagcaaggacaagagccgcagccgcagccatagcgctggcaagagccgcagcaagagcaaagaccaagctgaagagaagatccaaaacaatgacaatgtcgggaaacccaagagccggagtcctagcaggcataaaagtaggagtgtgagcaggggcaggagccaggagaagagcctccgccagagtcggagccggagcaggagcaaagcgggcagcaggagccggagcaggagccgcagcaagagcaaggacaagaggaagagcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcccgctccgtgtcaaaggagcgggaacatgccaagtctgaatccagccagagggaaggtcgaggagagagtgagaatgctggcaccaatcaggagacccggtccaggtcgagatccaattccaaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaagaaaagaaaagaattttttttaattttatttttccccgtcttgcaaagtatagtgacccctgtttccattaaatttgaataaagactatttttgcttgacaaaaaatcatg

SEQ ID NO: 72448 - DNA, 2044 bp, Homo sapiens
gtgctcgcgtacgtcgccggggttcggctgcgtccgtcccgccgcccgcccgttgccgccgccgccgctgccgccgtgctctcgctttgcccgccgccgcctaaggggggctggggccggggccagccatcactgccgttgccgggatgccgcgggtgtacatcggccgcctgagctaccaggcccgggagcgcgatgtggagcgcttctttaagggctacgggaagatcctggaggtggatctgaagaacggatatggttttgtggagtttgatgatctgcgtgatgcagatgatgctgtttatgaactgaatggcaaagacctttgtggtgagcgagtaattgttgagcatgcccgcggcccacggcgagatggcagttacggttctggacgcagtggatatggttatagaagaagtggccgagataaatatggccctcctactcgcacagagtacagacttattgtggagaatttgtcaagtcggtgcagctggcaagacctaaaggattatatgcgtcaggcaggagaagtgacttatgcagatgctcacaagggacgcaaaaatgaaggggtgattgaatttgtatcttattctgatatgaaaagagctttggaaaagttggatggaactgaagtcaatgggagaaaaatcagattagttgaagacaagccaggttccagacgacgccggtcctactccagaagccggagtcattcaaggtctcgctctcgaagcagacattcccgtaagagcagaagccgaagtggcagcagcaaaagcagtcattctaagagtagatctcggtccaggtcgggctcccgctcccggagcaagagccggagccggagccagagtcggagccggagcaagaaagagaaaagcaggagccccagcaaggacaagagccgcagccgcagccatagcgctggcaagagccgcagcaagagcaaagaccaagctgaagagaagatccaaaacaatgacaatgtcgggaaacccaagagccggagtcctagcaggcataaaagtaagagcaaaagtcggagcaggagtcaggagaggagagtggaggaggagaagcgagggagtgtgagcaggggcaggagccaggagaagagcctccgccagagtcggagccggagcaggagcaaagcgggcagcaggagccggagcaggagccgcagcaagagcaaggacaagaggaagagcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcccgctccgtgtcaaaggagcgggaacatgccaagttcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaagaaaagaaaagaattttttttaattttatttttccccgtcttgcaaagtatagtgacccctgtttccattaaatttgaataaagactatttttgcttgacaaaaaatcatg

SEQ ID NO: 72449 - DNA, 1246 bp, Homo sapiens
gtgctcgcgtacgtcgccggggttcggctgcgtccgtcccgccgcccgcccgttgccgccgccgccgctgccgccgtgctctcgctttgcccgccgccgcctaaggggggctggggccggggccagccatcactgccgttgccgggatgccgcgggtgtacatcggccgcctgagctaccaggcccgggagcgcgatgtggagcgcttctttaagggctacgggaagatcctggaggtggatctgaagaacggatatggttttgtggagtttgatgatctgcgtgatgcagatgatgctgtttatgaactgaatggcaaagacctttgtggtgagcgagtaattgttgagcatgcccgcggcccacggcgagatggcagttacggttctggacgcagtggatatggttatagaagaagtggccgagataaatatggccctcctactcgcacagagtacagacttattgtggagaatttgtcaagtcggtgcagctggcaagacctaaaggattatatgcgtcaggcaggagaagtgacttatgcagatgctcacaagggacgcaaaaatgaaggggtgattgaatttgtatcttattctgatatgaaaagagctttggaaaagttggatggaactgaagtcaatgggagaaaaatcagattagttgaagacaagccaggttccagacgacgccggtcctactccagaagccggagtcattcaaggtctcgctctcgaagcagacattcccgtaagagcagaagccgaagtggcagcagcaaaagcagtcattctaagagtagatctcggtccaggtcgggctcccgctcccggagcaagagccggagccggagccagagtcggagccggagcaagaaagagaaaagcaggagccccagcaaggacaagagccgcagccgcagccatagcgctggcaagagccgcagcaagagcaaagaccaagctgaagagaagatccaaaacaatgacaatgtcgggaaacccaagagccggagtcctagcaggcataaaagtacaagagcaaggacaagaggaagagcaggaagagaagcagagaggagagccgcagtcgcagtcgcagccgcagcaagagtgagaggagcagaaagcgaggcagcaagcgagacagcaaggcgggcagcaggagccggagcaggagccgcagcaagagcaaggacaagaggaagagcaggaagagaagcagagaggagagccgcagtcgatcg

SEQ ID NO: 72450 - DNA, 718 bp, Homo sapiens
ctgagctgtggccaacgtttgcagaccaggaatccacactagctctaatcagagagcccttggtgtgcgggaactgccagtctgccgacgtgaaaagagtcccagactgggtaatggtgagccctgaagtcgcaccccagctctgccactcagtgagcacggcaacatccctaatcctgaccagccatggagaggttcggttcttacaaggaaaatgagtgaatgtgggaatggctcaccacattgtgaaaacaaaactcacatcctgctgatggttggctgaggactgtcatgtccacatacaaagaaaagcatgtggcacagttttaggacaaagatatggttttgtggagtttgatgatctgcgtgatgcagatgatgctgtttatgaactgaatggcaaagacctttgtggtgagcgagtaattgttgagcatgcccgcggcccacggcgagatggcagttacggttctggacgcagtggatatggttatagaagaagtggccgagataaatatggccctcctactcgcacagagtacagacttattgtggagaatttgtcaagtcggtgcagctggcaagacctaaaggattatatgcgtcaggcaggagaagtgacttatgcatataatcctttacgtcttgccagctgcacccaggcgcacttctttcctatgtacatatccactcttgtcttggccgactgtcatctcag

SEQ ID NO: 72451 - DNA, 220 bp, Homo sapiens
actgtcctatcagtgtgtcctgactttttacctcataagaccaagttggctgaagcataggacatcactgagtgctttgaaacaaagctgtttgattcctgttcactgaatgccatttctttcagggtagatttaaggactttccccttaaagtacagtgctactgactctagattgagggttcaagccaccccgtgggttaacttcaacagatgaaaat

SEQ ID NO: 72452 - DNA, 1302 bp, Homo sapiens
cagggttcagaaagctgtggcccaggcagactgtcggttacacatgttcaaaacgggggaagggccggggcttctgcgcttcgcgaggtcttgctcccttggggacctggtctcccatctgaccctccaggccttagcttgcctcacatgtcagggcaggtatccacctaaccaggctgcaggggaggaggagggaagccgggaatggagcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcccgctccgtgtcaaaggagcgggaacatgccaagtctgaatccagccagagggaaggtcgaggagagagtgagaatgctggcaccaatcaggagacccggtccaggtcgagatccaattccaaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaagaaaagaaaagaattttttttaattttatttttccccgtcttgcaaagtatagtgacccctgtttccattaaatttgaataaagactatttttgcttgacaaaaaatcatg

SEQ ID NO: 72453 - DNA, 1391 bp, Homo sapiens
gtgctcgcgtacgtcgccggggttcggctgcgtccgtcccgccgcccgcccgttgccgccgccgccgctgccgccgtgctctcgctttgcccgccgccgcctaaggggggctggggccggggccagccatcactgccgttgccgggatgccgcgggtgtacatcggccgcctgagctaccaggcccgggagcgcgatgtggagcgcttctttaagggctacgggaagatcctggaggtggatctgaagaacggatatggttttgtggagtttgatgatctgcgtgatgcagatgatgctgtttatgaactgaatggcaaagacctttgtggtgagcgagtaattgttgagcatgcccgcggcccacggcgagatggcagttacggttctggacgcagtggatatggttatagaagaagtggccgagataaatatggccctcctactcgcacagagtacagacttattgtggagaatttgtcaagtcggtgcagctggcaagacctaaaggattatatgcgtcaggcaggagaagtgacttatgcagatgctcacaagggacgcaaaaatgaaggggtgattgaatttgtatcttattctgatatgaaaagagctttggaaaagttggatggaactgaagtcaatgggagaaaaatcagattagttgaagacaagccaggttccagacgacgccggtcctactccagaagccggagtcattcaaggtctcgctctcgaagcagacattcccgtaagagcagaagccgaagtggcagcagcaaaagcagtcattctaagagtagatctcggtccaggtcgggctcccgctcccggagcaagagccggagccggagccagagtcggagccggagcaagaaagagaaaagcaggagccccagcaaggacaagagccgcagccgcagccatagcgctggcaagagccgcagcaagagcaaagaccaagctgaagagaagatccaaaacaatgacaatgtcgggaaacccaagagccggagtcctagcaggcataaaagtaagagcaaaagtcggagcaggagtcaggagaggagagtggaggaggagaagcgagggagtgtgagcaggggcaggagccaggagaagagcctccgccagagtcggagccggagcaggagcaaagcgggcagcaggagccggagcaggagccgcagcaagagcaaggacaagaggaagagcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtcccaagtcggcgaagaagtcccgagtcggcgaaga

SEQ ID NO: 72454 - DNA, 953 bp, Homo sapiens
gtgctcgcgtacgtcgccggggttcggctgcgtccgtcccgccgcccgcccgttgccgccgccgccgctgccgccgtgctctcgctttgcccgccgccgcctaaggggggctggggccggggccagccatcactgccgttgccgggatgccgcgggtgtacatcggccgcctgagctaccaggcccgggagcgcgatgtggagcgcttctttaagggctacgggaagatcctggaggtggatctgaagaacggatatggttttgtggagtttgatgatctgcgtgatgcagatgatgctgtttatgaactgaatggcaaagacctttgtggtgagcgagtaattgttgagcatgcccgcggcccacggcgagatggcagttacggttctggacgcagtggatatggttatagaagaagtggccgagataaatatggccctcctactcgcacagagtacagacttattgtggagaatttgtcaagtcggtgcagctggcaagacctaaaggattatatgcgtcaggcaggagaagtgacttatgcagatgctcacaagggacgcaaaaatgaaggggtgattgaatttgtatcttattctgatatgaaaagagctttggaaaagttggatggaactgaagtcaatgggagaaaaatcagattagttgaagacaagccaggttccagacgacgccggtcctactccagaagccggagtcattcaaggtctcgctctcgaagcagacattcccgtaagagcagaagccgaagtggcagcagcaaaagcagtcattctaagagtagatctcggtccaggtcgggctcccgctcccggagcaagagccggagccggagccagagtcggagccggagcaagaaagagaaaagcaggagccccagtagctgtacctcacccgtggattgtttccttgggtgaatagatattgctgtggca

SEQ ID NO: 72455 - DNA, 607 bp, Homo sapiens
gaattccccccccccccccagtgctccgcgcgctcttgacgtccggagcccctggagtaggcgcttccggccattcatactgcagtcggtcagtgttcggttgaaggattctgtgtgctgtcggacccagagggtgacggcgccgctaggatgaagctcgtgagatttttgatgaaattgagtcatgaaactgtaaccattgaattgaagaacggaacacaggtccatggaacaatcacaggtgtggatgtcagcatgaatacacatcttaaagctgtgaaaatgaccctgaagaacagagaacctgtacagctggaaacgctgagtattcgaggaaataacattcggtattttattctaccagacagtttacctctggatacactacttgtggatgttgaacctaaggtgaaatctaagaaaagggaagctgttgcaggaagaggcagaggaagaggaagaggaagaggacgtggccgtggcagaggaagagggggtcctaggcgataatgtctctcaagatttcaaagtcatatgagatttgggatattttttgtacaggttgtgtttgtttatgtcagtttttaataaacataaatgtgggaca

SEQ ID NO: 72456 - DNA, 881 bp, Homo sapiens
  misc_feature (612)..(612): n is a, c, g, or t
gaattccccccccccccccagtgctccgcgcgctcttgacgtccggagcccctggagtaggcgcttccggccattcatactgcagtcggtcagtgttcggttgaaggattctgtgtgctgtcggacccagagggtgacggcgccgctaggatgaagctcgtgagatttttgatgaaattgagtcatgaaactgtaaccattgaattgaagaacggaacacaggtccatggaacaatcacaggtgtggatgtcagcatgaatacacatcttaaagctgtgaaaatgaccctgaagaacagagaacctgtacagctggaaacgctgagtattcgaggaaataacattcggtattttattctaccagacagtttacctctggatacactacttgtggatgttgaacctaaggtgaaatctaagaaaagggaagctgttgcaggaagaggcagaggaagaggaagaggaagaggacgtggccgtggcagaggaagagggggtcctaggcgataatgtctctcaagatttcaaagtcatatgagatttgggatattttttgtacaggttgtgtttgtttatgtcagtttttaataaacataaatgtgggacaaaaanaaaaaaaaaaaaaaaatttgttgggggcttgggccctgggaaaaggttttttaacccctttggttggggggcgcggccgcaagtgtttagtgtaacgtgtggccaaaggggttccccaaggaaaacccgggccacgacacaggggctgggtttctccccaaataaaaacggccggggggcaaccggaggttttggaaccaattccgaagggagtcccgaaggccatcgcgtggctcttcaccggggatccaaggaaccgatatatcgga

SEQ ID NO: 72457 - DNA, 504 bp, Homo sapiens
aatgtttgtacttttagtagagacggggtttcactgtgttagccaggatggtctgaatctcctgacctcgtgattcgcccgcctcggcctcccaaggtgctgggattacaggcgtgagccaccgcgtccggccgaacattagtttttaaagaaatgtattatgaatatagatagaaaacccaaagtgaaggaatagaaaatgaaatatcagtttcttttaatctatcataattatgtgagcataacttagtattttgaaatagattaatgtagtcagcaaacaattcatgtattacctataatagatatcatacatataacatttaataacatacagttcttgttcctgaagacttaacctagaaaataactccataacaagaagaatctctgtcataataaaccaacagcagacattttctaaaggcattaaaagtatatctgatactggcctttattaatgtgaaattcttgtggatctgtgaaataaagaggagtactttc

SEQ ID NO: 72458 - DNA, 401 bp, Homo sapiens
tgattacgaattcggaccccggtcctcaacggattattttagtgaccattaactccaagttataacttggagttaatggtcactagattatcagttatgagcagtgttaaaatctcctattaatgtgtaatgtacctgtcagtgcctcctttattaaggggttctttgagaataaaagagaaaagacctactttatttgacagcaaaactgttctaattgttaataaggacttttaaaaattgtttttgatttgctaagctcagaaaaaatgtctctcagtgcatcagttctttgtaaagcttactacgaagtatttatatgctaaggaaaacaactgaggatgtgggtggcttaaatctgtattttcatcaatctctggtgggcggggatcaactagagt

SEQ ID NO: 72459 - DNA, 2250 bp, Homo sapiens
gaattccccccccccccccagtgctccgcgcgctcttgacgtccggagcccctggagtaggcgcttccggccattcatactgcagtcggtcagtgttcggttgaaggattctgtgtgctgtcggacccagagggtgacggcgccgctaggatgaagctcgtgagatttttgatgaaattgagtcatgaaactgtaaccattgaattgaagaacggaacacaggtccatggaacaatcacaggtgtggatgtcagcatgaatacacatcttaaagctgtgaaaatgaccctgaagaacagagaacctgtacagctggaaacgctgagtattcgaggaaataacattcggtattttattctaccagacagtttacctctggatacactacttgtggatgttgaacctaaggtgaaatctaagaaaagggaagctgttgcaggaagaggcagaggaagaggaagaggaagaggacgtggccgtggcagaggaagagggggtcctaggcgataatgtctctcaagatttcaaagtcatatgagatttgggatattttttgtacaggttgtgtttgtttatgtcagtttttaataaacataaatgtgggacagagctgtctatttagtatatcaaagttttagtagtttcctccacattcacgaaattaccacagtgagagctaagcatttctactgggcagtttcatttttagttgatcaggttttaagtttttgaactaaaatttttctttttctttttatgatgaataaggttaaaataaaagccttagacaaattaaatttggcagagtttaattgagcaaaggacaattcacaaatcaggtagcccctgaaccataataggctcagaggcttcagcccagctgcatagttgaagatttatggacagaaggaaagtgatgtatggaaaatggaagtgagatacagcaacagccggattagttacagttcagcgtttgccttatttgaatatggtttgaacagttcgctgtctttggttggctgaaacttagtgattgccacaagagtagggtaccgtctgtttacacgtccagttaggctacagttctatgtactgagaaacctttaagctgaacttgagatatgtaaagagactttaggctaaacttaacaatatatataggatatatacccttctacttcacatgcactgaatatgcattttattgctttactcttcattctgtggcacctacccacaggggaagtaagaagtttgttttggtatttcggaaactaaagtccttatgggatggggtctagaattgattctcctttcctgagttttactccacggagtcttaggtacctggtaaaaagttgtcttctaaattaagggtcattgctttgttgtctagctgctaatgtcttacttttgtttcttttgctttttaatcagttcttaataggatatagttttatgttttccaagttataacttggagttaatggtcactagattatcagttatgagcagtgttaaaatctcctattaatgtgtaatgtacctgtcagtgcctcctttattaaggggttctttgagaataaaagagaaaagacctactttatttgacagcaaaactgttctaattgttaataaggacttttaaaaattgtttttgatttgctaagctcagaaaaaatgtctctcagtgcatcagttctttgtaaagcttactacgaagtatttatatgctaaggaaaacaactgaggatgtgggtggcttaaatctgtattttcatcatgtatgtgagtttttttttttttaagtaaagaaattttctgcaaagatcgttaccttaaaaaagtttagcctgggcgtgagccaccgcgtccggccgaacattagtttttaaagaaatgtattatgaatatagatagaaaacccaaagtgaaggaatagaaaatgaaatatcagtttcttttaatctatcataattatgtgagcataacttagtattttgaaatagattaatgtagtcagcaaacaattcatgtattacctataatagatatcatacatataacatttaataacatacagttcttgttcctgaagacttaacctagaaaataactccataacaagaagaatctctgtcataataaaccaacagcagacattttctaaaggcattaaaagtatatctgatactggcctttattaatgtgaaattcttgtggatctgtgaaataaagaggagtactttc

SEQ ID NO: 72460 - DNA, 2032 bp, Homo sapiens
ctgctcgaattcaagcttctaacgtgtggatgtcagcatgaatacacatcttaaagctgtgaaaatgaccctgaagaacagagaacctgtacagctggaaacgctgagtattcgaggaaataacattcggtattttattctaccagacagtttacctctggatacactacttgtggatgttgaacctaaggtgaaatctaagaaaagggaagctgttgcaggaagaggcagaggaagaggaagaggaagaggacgtggccgtggcagaggaagagggggtcctaggcgataatgtctctcaagatttcaaagtcatatgagatttgggatattttttgtacaggttgtgtttgtttatgtcagtttttaataaacataaatgtgggacagagctgtctatttagtatatcaaagttttagtagtttcctccacattcacgaaattaccacagtgagagctaagcatttctactgggcagtttcatttttagttgatcaggttttaagtttttgaactaaaatttttctttttctttttatgatgaataaggttaaaataaaagccttagacaaattaaatttggcagagtttaattgagcaaaggacaattcacaaatcaggtagcccctgaaccataataggctcagaggcttcagcccagctgcatagttgaagatttatggacagaaggaaagtgatgtatggaaaatggaagtgagatacagcaacagccggattagttacagttcagcgtttgccttatttgaatatggtttgaacagttcgctgtctttggttggctgaaacttagtgattgccacaagagtagggtaccgtctgtttacacgtccagttaggctacagttctatgtactgagaaacctttaagctgaacttgagatatgtaaagagactttaggctaaacttaacaatatatataggatatatacccttctacttcacatgcactgaatatgcattttattgctttactcttcattctgtggcacctacccacaggggaagtaagaagtttgttttggtatttcggaaactaaagtccttatgggatggggtctagaattgattctcctttcctgagttttactccacggagtcttaggtacctggtaaaaagttgtcttctaaattaagggtcattgctttgttgtctagctgctaatgtcttacttttgtttcttttgctttttaatcagttcttaataggatatagttttatgttttccaagttataacttggagttaatggtcactagattatcagttatgagcagtgttaaaatctcctattaatgtgtaatgtacctgtcagtgcctcctttattaaggggttctttgagaataaaagagaaaagacctactttatttgacagcaaaactgttctaattgttaataaggacttttaaaaattgtttttgatttgctaagctcagaaaaaatgtctctcagtgcatcagttctttgtaaagcttactacgaagtatttatatgctaaggaaaacaactgaggatgtgggtggcttaaatctgtattttcatcatgtatgtgagtttttttttttttaagtaaagaaattttctgcaaagatcgttaccttaaaaaagtttagcctgggcgtgagccaccgcgtccggccgaacattagtttttaaagaaatgtattatgaatatagatagaaaacccaaagtgaaggaatagaaaatgaaatatcagtttcttttaatctatcataattatgtgagcataacttagtattttgaaatagattaatgtagtcagcaaacaattcatgtattacctataatagatatcatacatataacatttaataacatacagttcttgttcctgaagacttaacctagaaaataactccataacaagaagaatctctgtcataataaaccaacagcagacattttctaaaggcattaaaagtatatctgatactggcctttattaatgtgaaattcttgtggatctgtgaaataaagaggagtactttc

SEQ ID NO: 72461 - DNA, 839 bp, Homo sapiens
tgattacgaattcggaccccggtcctcaacggattattttagtgaccattaactccaagttataacttggagttaatggtcactagattatcagttatgagcagtgttaaaatctcctattaatgtgtaatgtacctgtcagtgcctcctttattaaggggttctttgagaataaaagagaaaagacctactttatttgacagcaaaactgttctaattgttaataaggacttttaaaaattgtttttgatttgctaagctcagaaaaaatgtctctcagtgcatcagttctttgtaaagcttactacgaagtatttatatgctaaggaaaacaactgaggatgtgggtggcttaaatctgtattttcatcatgtatgtgagtttttttttttttaagtaaagaaattttctgcaaagatcgttaccttaaaaaagtttagcctgggcgtgagccaccgcgtccggccgaacattagtttttaaagaaatgtattatgaatatagatagaaaacccaaagtgaaggaatagaaaatgaaatatcagtttcttttaatctatcataattatgtgagcataacttagtattttgaaatagattaatgtagtcagcaaacaattcatgtattacctataatagatatcatacatataacatttaataacatacagttcttgttcctgaagacttaacctagaaaataactccataacaagaagaatctctgtcataataaaccaacagcagacattttctaaaggcattaaaagtatatctgatactggcctttattaatgtgaaattcttgtggatctgtgaaataaagaggagtactttc

SEQ ID NO: 72462 - DNA, 1606 bp, Homo sapiens
gaattccccccccccccccagtgctccgcgcgctcttgacgtccggagcccctggagtaggcgcttccggccattcatactgcagtcggtcagtgttcggttgaaggattctgtgtgctgtcggacccagagggtgacggcgccgctaggatgaagctcgtgagatttttgatgaaattgagtcatgaaactgtaaccattgaattgaagaacggaacacaggtccatggaacaatcacaggtgtggatgtcagcatgaatacacatcttaaagctgtgaaaatgaccctgaagaacagagaacctgtacagctggaaacgctgagtattcgaggaaataacattcggtattttattctaccagacagtttacctctggatacactacttgtggatgttgaacctaaggtgaaatctaagaaaagggaagctgttgcaggaagaggcagaggaagaggaagaggaagaggacgtggccgtggcagaggaagagggggtcctaggcgataatgtctctcaagatttcaaagtcatatgagatttgggatattttttgtacaggttgtgtttgtttatgtcagtttttaataaacataaatgtgggacagagctgtctatttagtatatcaaagttttagtagtttcctccacattcacgaaattaccacagtgagagctaagcatttctactgggcagtttcatttttagttgatcaggttttaagtttttgaactaaaatttttctttttctttttatgatgaataaggttaaaataaaagccttagacaaattaaatttggcagagtttaattgagcaaaggacaattcacaaatcaggtagcccctgaaccataataggctcagaggcttcagcccagctgcatagttgaagatttatggacagaaggaaagtgatgtatggaaaatggaagtgagatacagcaacagccggattagttacagttcagcgtttgccttatttgaatatggtttgaacagttcgctgtctttggttggctgaaacttagtgattgccacaagagtagggtaccgtctgtttacacgtccagttaggctacagttctatgtactgagaaacctttaagctgaacttgagatatgtaaagagactttaggctaaacttaacaatatatataggatatatacccttctacttcacatgcactgaatatgcattttattgctttactcttcattctgtggcacctacccacaggggaagtaagaagtttgttttggtatttcggaaactaaagtccttatgggatggggtctagaattgattctcctttcctgagttttactccacggagtcttaggtacctggtaaaaagttgtcttctaaattaagggtcattgctttgttgtctagctgctaatgtcttacttttgtttcttttgctttttaatcagttcttaataggatatagttttatgttttccaagttataacttggagttaatggtcactagattatcagttatgagcagtgttaaaatctcctattaatgtgtaatgtacctgtcagtgcctcctttattaaggggttctttgagaataaaagagaaaagacctacttta

SEQ ID NO: 72463 - DNA, 2197 bp, Homo sapiens
cctcacagaccctgaaggaatatgtaaggctgaataatttataaagaaaacaggtttatttggatcacagttccataggctatacaagaagtgtagtgccagcatctgcttctggtgaaacctcaggaagtttacaatcatggcagaagcagtgaagcacggaacacaggtccatggaacgatcacaggtgtggatgtcagcatgaatacacatcttaaagctgtgaaaatgaccctgaagaacagagaacctgtacagctggaaacgctgagtattcgaggaaataacattcggtattttattctaccagacagtttacctctggatacactacttgtggatgttgaacctaaggtgaaatctaagaaaagggaagctgttgcaggaagaggcagaggaagaggaagaggaagaggacgtggccgtggcagaggaagagggggtcctaggcgataatgtctctcaagatttcaaagtcatatgagatttgggatattttttgtacaggttgtgtttgtttatgtcagtttttaataaacataaatgtgggacagagctgtctatttagtatatcaaagttttagtagtttcctccacattcacgaaattaccacagtgagagctaagcatttctactgggcagtttcatttttagttgatcaggttttaagtttttgaactaaaatttttctttttctttttatgatgaataaggttaaaataaaagccttagacaaattaaatttggcagagtttaattgagcaaaggacaattcacaaatcaggtagcccctgaaccataataggctcagaggcttcagcccagctgcatagttgaagatttatggacagaaggaaagtgatgtatggaaaatggaagtgagatacagcaacagccggattagttacagttcagcgtttgccttatttgaatatggtttgaacagttcgctgtctttggttggctgaaacttagtgattgccacaagagtagggtaccgtctgtttacacgtccagttaggctacagttctatgtactgagaaacctttaagctgaacttgagatatgtaaagagactttaggctaaacttaacaatatatataggatatatacccttctacttcacatgcactgaatatgcattttattgctttactcttcattctgtggcacctacccacaggggaagtaagaagtttgttttggtatttcggaaactaaagtccttatgggatggggtctagaattgattctcctttcctgagttttactccacggagtcttaggtacctggtaaaaagttgtcttctaaattaagggtcattgctttgttgtctagctgctaatgtcttacttttgtttcttttgctttttaatcagttcttaataggatatagttttatgttttccaagttataacttggagttaatggtcactagattatcagttatgagcagtgttaaaatctcctattaatgtgtaatgtacctgtcagtgcctcctttattaaggggttctttgagaataaaagagaaaagacctactttatttgacagcaaaactgttctaattgttaataaggacttttaaaaattgtttttgatttgctaagctcagaaaaaatgtctctcagtgcatcagttctttgtaaagcttactacgaagtatttatatgctaaggaaaacaactgaggatgtgggtggcttaaatctgtattttcatcatgtatgtgagtttttttttttttaagtaaagaaattttctgcaaagatcgttaccttaaaaaagtttagcctgggcgtgagccaccgcgtccggccgaacattagtttttaaagaaatgtattatgaatatagatagaaaacccaaagtgaaggaatagaaaatgaaatatcagtttcttttaatctatcataattatgtgagcataacttagtattttgaaatagattaatgtagtcagcaaacaattcatgtattacctataatagatatcatacatataacatttaataacatacagttcttgttcctgaagacttaacctagaaaataactccataacaagaagaatctctgtcataataaaccaacagcagacattttctaaaggcattaaaagtatatctgatactggcctttattaatgtgaaattcttgtggatctgtgaaataaagaggagtactttc

SEQ ID NO: 72464 - DNA, 483 bp, Homo sapiens
gaacataaatataggttggagaatttacagagattcttcagagactggagagagatatctaaatcgccttcctatacctggcactcaagctaactattgcccctagacatcaggaggctttgcactgactgtgacgacaggccaccatccctgcaactggttagtcaatgtgtctcttcctcacacactgaccatgtgctcatgagagcaggggctgtatctgcctgtttcattcatacttctggcaacatgcttggtatatttgcacttataaatgtttgctgaatacataaattaactacttcatacatgggttcatgcacagctatatagaaaaccatgacctcaaaatacagatacttggctgggcatggtagcttatgcctgtaatcctaccactttgggagtccaaggcgggaggattgcttgagtcaaggagtttctagaccagcctgggcaacatagcatgaacttgtctttaca

SEQ ID NO: 72465 - DNA, 721 bp, Homo sapiens
ggcggggctgtctgtggcctcagcgctcggcaggcgcgcactcagctccacacccggctctctcggcatctcagacccggtttcacacaatcatcaggtgagccgaggatccattggaggaaggcattatctgtatccagaggaaatagccaaggatattcagaggtgtgcctgggaagtttgagctgcagcagtggaaccttaatgcccaggatgatcctgtctaacaccacagcggtgacgccctttctgaccaagctgtggcaggagacagttcagcagggtggcaacatgtcgggcctggcccgcaggtccccccgcagcggtgacggcaagctggaggccctctacgtcctcatggtactgggattcttcggcttcttcaccctgggcatcatgctgagctacatccgctccaagaagctggagcactcgaacgacccattcaacgtctacatcgagtccgatgcctggcaagagaaggacaaggcctatgtccaggcccgggtcctggagagctacaggtcgtgctatgtcgttgaaaaccatctggccatagaacaacccaacacacaccttcctgagacgaagccttccccatgaaccccaccactggctaaaactggacacatcctgcctggcaacctgattttctaatcacattcctctcatactctttattgtgatggataccactggatttctttttggctgttgtaag

SEQ ID NO: 72466 - DNA, 307 bp, Homo sapiens
tgttctaaacctaaaggatgcttttttcacaattcctttacaccctgattctcaagacctctttgcctttatgtgggaagaccctgacacctttcacaccagctcacatgcatactacctcaaggtttcagaaacagcccccaccattttgggcagggaaagctcagaggcctagaaaatgcaaacacatagggtgaacttaatgttgcttaagtatgcgattatgattggtttgtcccttaatcttcaggctttgggtattttctaaatgctatgtgataaacttttatcatttgtataatcaaaa

SEQ ID NO: 72467 - DNA, 213 bp, Homo sapiens
tttctttctcactcagacacagtaggttaagttctcttatactccttcttcttactttgacattggagttgaccacatgatggtgttccacacttcccttaggctatgttcatttgttcatttttcttttcttttcttttcttttttgacatgcagtctcactctgtcacccaaagctggagtgcagtggtgtgatcttggctcactgcaacc

SEQ ID NO: 72468 - DNA, 495 bp, Homo sapiens
ctatcccagggttatttgtaatataacagaagaaactttaaggtaaaggaatgagtctctgattgtggaacttatgctactggggagatccttgaggaagtaaaatgtcttcaaagtgttcttgaaatcacatgatattgagggtggatatgggtcaattcaggcatatatgtttatttatatccctgtgtatacctatgtagatgtgtacattcagagagacatggcttatcactgtcaaggtcccactgctgctactgtatcgactgatgagtgaccaagagccttttctgaaccatgtactaaaatcactgagttaagaatcaagacaataattaaactattctgaaatgtcctttcatagttttcattcactcactgaagtgactgtgtgagtgccttctttttagaaggccaaaataggcttcttctgaccgggtgcagtggctcgtgcctgtaatcccagcactttgggaggccgaggcgggtggatca

SEQ ID NO: 72469 - DNA, 279 bp, Homo sapiens
caatggttccacatagccatgaaatcagctgttacaataggaagaccaccactgaacagttttgtaactcatttcagaattgactttggtatgtgcttattggtgtatttctgtgcttgtgtcaattcaacaaagcttcccaagcaaggttacttcaaacattacttgggccacggtaaaagaaaaataaaattctgttgattcagagtcaccttcaatctcatgtcataaattatgtttctctagtctttgatattgtttcacatgtgcatgattaga

SEQ ID NO: 72470 - DNA, 398 bp, Homo sapiens
cgcgccaccgtggagggcataggggacaggtcaaaagttccagtgaagtcctgggaggtggtgtgagaagtttactctggggacagggagatgatctgcttaaaaagcaagttaatttttcttattgctgttcctttggctcttttacaatggaatgacaaaggaatgggtgcacagagaaatgctggtggcctgcattgagaatttctgatgaggtaggctgagaaactgacaaatgagctgtcagctccgctgcaatgacacttcaggggccaggtttttttagcttttatatatataatatatattatcacactgcacactatatatgtaataaatattatacaatatgtttaaaaaatgaaaattaaaattttcatctttattgaggtataatt

SEQ ID NO: 72471 - DNA, 1462 bp, Homo sapiens
  misc_feature (1181)..(1181): n is a, c, g, or t
  misc_feature (1412)..(1412): n is a, c, g, or t
  misc_feature (1414)..(1414): n is a, c, g, or t
  misc_feature (1416)..(1416): n is a, c, g, or t
  misc_feature (1426)..(1426): n is a, c, g, or t
  misc_feature (1432)..(1432): n is a, c, g, or t
  misc_feature (1439)..(1439): n is a, c, g, or t
  misc_feature (1448)..(1448): n is a, c, g, or t
  misc_feature (1450)..(1450): n is a, c, g, or t
  misc_feature (1455)..(1455): n is a, c, g, or t
  misc_feature (1457)..(1457): n is a, c, g, or t
  misc_feature (1459)..(1459): n is a, c, g, or t
  misc_feature (1461)..(1461): n is a, c, g, or t
gcttaatcagcagggaaacccaaacatgaacctccacgagctgtcactgcaccacacacctaccagaatggctgacattttaaataagctgacagcactaaatgttgacgtggatggggagcaacaggaactctcattcgctgccggcggcagtacaaaatggtacagcaactttgggagccagcctggcagtttcatattaaattaaatgtacacctactctgtaacccagcagtcgggctcctgggtgttcaccaagtgaaatgaaaacacgtccacagaaaaacctgtccatgagtatttatagctgcttgattcattaattctccagactggaaacaacctgtgtccttcatccagcaaatggatgcacgggaaggtggcgtatttatactgcggggcaacacacaggatggatctcaaaggcgtcatgctgagtaggtggttggctgaatcatggccacagcagattccaggaacctgtgagtgtaaccttctgtggaaaaagggactttgcagatgagattaggttaaggatcttgagatggggaggttaccctgcattatctgggtggtccctgtttgtcatcacaagtgtcctcgtaagagagggacagatttaatgtagacagaagaggacttgaaggctgcatgaccccagtgggcagagattagggtgatgcagccacaagccagggagtgcctgagcctgcagcaggtgaagaggccaggaaaggtcctcccctagagcccccaaaaggagggagcctgctaacacttggatttcagacttctggcccccagtccgtgagagaaccagtttccattgttttaagccacaagtttatgctcagttgttgcaaggaccacgggaaactcatcttatgtgattccattgataagactttctggaaaggcaaaaccatagggacaaaaaaacagatccaggattgctgagggtgcggggagggtcagtctccaagtggggatgcaggaaattgggcagaaaggaaggtggcctgctcagcgtgctgtcctgggaaaagcaagcaaggtgcgtggagcgtgtagaggccacagttttgggcaatctgcatatttttgtctacaagatttctgaaaaacccttttccataagctttctatgcaccttcgtgaatgcagatagaaatatctgctgngggctgggtgcggtggctcacacctgtaatcctggcactttgggaggctgagtctgtcgagttgcttgaacctaggagttcaagtccagcctgggcaacatggcaaaaccctatctctacagaaaatagaaaaattagccaggtgtgttggtgtgtgcctgtggtcccagctactcgggagctgaggcaggaggatcacctgagcctagaaggtcgaagctgcagtgagcngngntcacaccacngcactncagcctnggtgacagngngagancntntnt

SEQ ID NO: 72472 - DNA, 966 bp, Homo sapiens
ggcctgtgcgagtgacgggaagagccgctgccagaggattccaggaagtgactcacctggggaaactgctcagaacccagcgggctggcggtggtggcttagcggtattgggacgcctgtcccgtctacactgcttgtctctgagctcagcgtggcatctgctgattgctgctccaatgcaatcctttgctgttttctagtgggaaggatgagctaaacgacaaggcttgtgtgcgaggaatgaaggagaggtggataggtgtgatttatttcttggcggaagctcgcatattcagcgatccctgttctgcaaatgtggcacctttcttaaacagagagaatgcctccttgcctgcgcccagcactttcccgtttgcagtggctttctcacgagcattctcgtttggatctcccaaacccgaggcacagtgaggcgaggagttaggagtaaggagggttggttacaaaattggccgcacacctcttcctgtcctatctctgcaccggagatccgagcctccccgctgagctggtataaaataagatggtcgtttttcttagtatgctttaaatctgtacaagggtttgtgaatgagaaaatgtatctgtttaatttctcctttgtaaagctattagctttttccaacacctcctgttcctaatggggaaagagtgtggattcattacaaaaaataaataagagaaaggcaaaaaaaaaaaacattacccacaacaaaaactttttggggcggcttgggccctggaaagagtttttaaaacccttcgtgtggggcgcaggggcccccaagataggcaagtacgaccggtggccatagacgggtcccccgagggaacccggggcacagacaaagggggtgggattcttccccgatataaaaacgcgcggggggcaaccgaccgttctgaaaaaacccagagggacccggagccatcagggactcacag

SEQ ID NO: 72473 - DNA, 397 bp, Homo sapiens
ccgcgggggcagaagtgtccggcggggatccggacagcgcatccggaagcgccatgggccaacgctcgcaggaacctgaacccctgggccagcgccgcctttgctcgcagaggcctctagcatctgtactgtcgaagccctctgagcttcagggcagactgaagagccttacacaccagacacttggacgcgatcgcgccagaaatccccgggaattcagtcttggctccgactccaaaacaaatgattcctcaccagccagatctccatcattggcggtagtctctggtcacctgacttgttcaagccaatgagagggggccgaattagtacttccgctttccgtgctgtttaacgagccactatgcccgtccctcggatactctgattggccagc

SEQ ID NO: 72474 - DNA, 360 bp, Homo sapiens
ttgagacggagctttccctgtcacccatgctggagtgcagtggcgctatctcagctcactacaacctccacctcccaggtccaagtgattctcccgcctcagcctcccaagcagctgggattacaggcgtgagtcacctgcctcagcctcccacagtgctgggattacagttgtgagccactgcgccaggcctcccaaggtgttgggattacaggcgtgagccaccgctccgggcctcccacagtgctaggattacaggtgtcagctgctgcacctggcaattttttgatattaggtcccctgaagtccaaaaagagatatatggcttatttggtataatgaaatcatacaggaagcatt

SEQ ID NO: 72475 - DNA, 401 bp, Homo sapiens
gagtatcactatatcgcgcaagctggtctcaaactcctgggctcaagcagtccttctgtcttggactcccaaagtgctgggattacaggcatgagccaaggcaaccggcctatattatcatgtaataaaagtaacatgcaggctgcgcgcagtggctcacgcctgtaatcccaggcgtctctacaaaaaagaataaaataatgtattttttaatggggaaagctttcacatggtgtaaagtccagaaagtggaaacaattatatgcagtgaaaagccgccttcctgtatttcccaccatagatttctatatagaggcaaccatttttaataattttttgtgcatccattcagctttttaaaatttatatccaagagaatacaaatatacggttttcctttg

SEQ ID NO: 72476 - DNA, 1707 bp, Homo sapiens
ctttttgggcgtggaaagatggcgtaaaaagccacaatacgcaggcgtcatcgctcacttttcccctcccggcttctgctccacctgacgcctgcgcagtaagtaagcctgccagacacactgtgacggctgcctgaagctagtgagtcgcggcgccgcgcactggtggttgggtcagtgccgcgcgccgatcggtcgttaccgcgaggcgctggtggccttcaggctggacggcgcgggtcagccctggttcgccggcttctgggtctttgaacagccgcgatgtcgatcttcacccccaccaaccagatccgcctaaccaatgtggccgtggtacggatgaagcgtgccgggaagcgcttcgaaatcgcctgctacaaaaacaaggtcgtcggctggcggagcggcgtggaaaaagacctcgatgaagttctgcagacccactcagtgtttgtaaatgtttctaaaggtcaggttgccaaaaaggaagatctcatcagtgcgtttggaacagatgaccaaactgaaatctgtaagcagattttgactaaaggagaagttcaagtatcagataaagaaagacacacacaactggagcagatgtttagggacattgcaactattgtggcagacaaatgtgtgaatcctgaaacaaagagaccatacaccgtgatccttattgagagagccatgaaggacatccactattcggtgaaaaccaacaagagtacaaaacagcaggctttggaagtgataaagcagttaaaagagaaaatgaagatagaacgtgctcacatgaggcttcggttcatccttccagtcaatgaaggcaagaagctgaaagaaaagctcaagccactgatcaaggtcatagaaagtgaagattatggccaacagttagaaatcgtatgtctgattgacccgggctgcttccgagaaattgatgagctaataaaaaaggaaactaaaggcaaaggttctttggaagtactcaatctgaaagatgtagaagaaggagatgagaaatttgaatgacacccatcaatctcttcacctctaaaacactaaagtgtttccgtttccgacggcactgtttcatgtctgtggtctgccaaatacttgcttaaactatttgacattttctatctttgtgttaacagtggacacagcaaggctttcctacataagtataataatgtgggaatgatttggttttaattataaactggggtctaaatcctaaagcaaaattgaaactccaagatgcaaagtccagagtggcattttgctactctgtctcatgccttgatagctttccaaaatgaaagttacttgaggcagctcttgtgggtgaaaagttatttgtacagtagagtaagattattaggggtatgtctatacaacaaaagggggggtctttcctaaaaaagaaaacatatgatgcttcatttctacttaatggaacttgtgttctgagggtcattatggtatcgtaatgtaaagcttggatgatgttcctgattatctgagaaacagatatagaaaaattgtgccggacttacctttcattgaacatgctgccataacttagattattcttggttaaaaaataaaagtcacttatttctaattcttaaagtttataatatatattaatatagctaaaattgtatgtaatcaataaaaccactcttatgtttattaaac

SEQ ID NO: 72477 - DNA, 756 bp, Homo sapiens
cccacgcgtccgtcgacccacgcgtccgcggacgcgtgggtcaatctgaaagatgtagaagaaggagatgagaaatttgaatgacacccatcaatctcttcacctctaaaacactaaagtgtttccgtttccgacggcactgtttcatgtctgtggtctgccaaatacttgcttaaactatttgacattttctatctttgtgttaacagtggacacagcaaggctttcctacataagtataataatgtgggaatgatttggttttaattataaactggggtctaaatcctaaagcaaaattgaaactccaagatgcaaagtccagagtggcattttgctactctgtctcatgccttgatagctttccaaaatgaaagttacttgaggcagctcttgtgggtgaaaagttatttgtacagtagagtaagattattaggggtatgtctatacaacaaaagggggggtctttcctaaaaaagaaaacatatgatgcttcatttctacttaatggaacttgtgttctgagggtcattatggtatcgtaatgtaaagcttggatgatgttcctgattatctgagaaacagatatagaaaaattgtgccggacttacctttcattgaacatgctgccataacttagattattcttggttaaaaaataaaagtcacttatttctaattcttaaagtttataatatatattaatatagctaaaattgtatgtaatcaataaaaccactcttatgtttattaaac

SEQ ID NO: 72478 - DNA, 929 bp, Homo sapiens
cgtcccgtgtacgggaggtggagaaatcgtatgtctgattgacccgggctgcttccgagaaattgatgagctaataaaaaaggaaactaaaggcaaaggttctttggaagtactcaatctgaaagatgtagaagaaggagatgagaaatttgaatgacacccatcaatctcttcacctctaaaacactaaagtgtttccgtttccgacggcactgtttcatgtctgtggtctgccaaatacttgcttaaactatttgacattttctatctttgtgttaacagtggacacagcaaggctttcctacataagtataataatgtgggaatgatttggttttaattataaactggggtctaaatcctaaagcaaaattgaaactccaagatgcaaagtccagagtggcattttgctactctgtctcatgccttgatagctttccaaaatgaaagttacttgaggcagctcttgtgggtgaaaagttatttgtacagtagagtaagattattaggggtatgtctatacaacaaaagggggggtctttcctaaaaaagaaaacatatgatgcttcatttctacttaatggaacttgtgttctgagggtcattatggtatcgtaatgtaaagcttggatgatgttcctgattatctgagaaacagatatagaaaaattgtgccggacttacctttcattgaacatgctgccataacttagattattcttggttaaaaaataaaagtcacttatttctaattcttaaagtttataatatatattgtaaatgttgtatcaaaacctctagttttataaaaaaaaaaaaaaaaaagggggcgaaaatccggggcatgccttggaaggccaaggggaaaggagggggaaagggggaagggggttggactgggggggaccaaggaatgggggggggagaaa

SEQ ID NO: 72479 - DNA, 484 bp, Homo sapiens
tgtctcatgcctgatagctttccaaaatgaaagttacttgaggcagagtccagagtggcattttgctactctgtctcatgccttgatagctttccaaaatgaaagttacttgaggcagctcttgtgggtgaaaagttatttgtacagtagagtaagattattaggggtatgtctatacaacaaaagggggggtctttcctaaaaaagaaaacatatgatgcttcatttctacttaatggaacttgtgttctgagggtcattatggtatcgtaatgtaaagcttggatgatgttcctgattatctgagaaacagatatagaaaaattgtgccggacttacctttcattgaacatgctgccataacttagattattcttggttaaaaaataaaagtcacttatttctaattcttaaagtttataatatatattaatatagctaaaattgtatgtaatcaataaaaccactcttatgtttattaaac

SEQ ID NO: 72480 - DNA, 887 bp, Homo sapiens
  misc_feature (530)..(530): n is a, c, g, or t
  misc_feature (534)..(534): n is a, c, g, or t
gggcagttcacttgaggccaggagttcgaggccagcctggccaacatgaaaccccatctctactaaaaatacaaagttagccgggtgtggtggcgcatgcctgtaatcccagttactcaggaggctgaggcgggagaatcacttgaacccgggaggctgaggttacagtgagccgagatcgcgccattgcactccagcctgggcaaaaacagtgaaattccatctaggggcgggggttggggggtaagaaaaagaaaactgccctctacactaaaggtcatcagggggatttgttgtgtcttgccgttcatgttgttgccatctcgtatttaaatgtaaatgcatgtccaagtttcaagtatattcacataggactttctctcctgccctcacaagggaaaaagacctcgatgaagttctgcagacccactcagtgtttgtaaatgtttctaaaggtcaggttgccaaaaaggaagatctcatcagtgcgtttggaacagatgaccaaactgaaatctgtaagcagattntganaaaggagaagtcaagtattcacgatccaaaaggacaagacacatcaacaaaatggggagacaggaatggtttaggggggaaccattgggcaccaaactggtggggctggacccccacatggtcgttgacgcatcccttgacaccataagcaagaacccatcacacccgtggaatcctttgacctggaaagaagcccccggcacagtgctaacatcccaagaaaatacgggaccgcaacgaccctacgacgacagggacccaaaaaccagcacgcacacgtgcaagatgtcatactagacgagatcacaacaagaaatagcaaccaacacaaagggacccccaacaaagcgctg

SEQ ID NO: 72481 - DNA, 1035 bp, Homo sapiens
aaaaataaaagtcacttatttctaattcttaaagtttataatatatattaatatagctaaaattgtatgtaatcaataaaaccactcttatgtttattaaaaaagaaaacatatgatgcttcatttctacttaatggaacttgtgttctgagggtcattatggtatcgtaatgtaaagcttggatgatgttcctgattatctgagaaacagatatagaaaaattgtgccggacttacctttcattgaacatgctgccataacttagattattcttggttaaaaaataaaagtcacttatttctaattcttaaagtttataatatatattaatatagctaaaattgtatgtaatcaataaaaccactcttatgtttattaaacaaaaaaaaaaaaaaacaacaaacaacaaaacaaaaaaaaaaaaaaaaaaaaaagaaaaaaaaaaaaaagagaagaggacagaacgaacacaacaccctcgcgaatacgagaaatatgaacagcgacgccggaacgagaaaacgcgggccacagaacagaacaccctaaacaaataaccaaccagaacaagctaaacaaacaaaaacaaacaagaacaacagaaaataagaacaataagaaaaacgaaaatatagaaacaatacacaatatagaaaaaacaaaaaaaaacaaacatcacaaaaaataacacatccttctcttacactcactacaccaccacactatataacataaacacacaattccttctcagtcatacacacccacacatatcatactacaataatatcaatatccacatacaaaaacaacaaacgataaaactacacaaaacgagcaggatacaaatacaacaaaaaacataccaattacatatacctcaatcacacaaaatacacaaacacacataccaataaatcaacaacataaaaaacataacaacaaataataaaatacacaattatatatataaaataaataaaactataaacatatataataaatattcaaatacacaataacaaattaaactt

SEQ ID NO: 72482 - DNA, 1884 bp, Homo sapiens
  misc_feature (1746)..(1746): n is a, c, g, or t
ctttttgggcgtggaaagatggcgtaaaaagccacaatacgcaggcgtcatcgctcacttttcccctcccggcttctgctccacctgacgcctgcgcagtaagtaagcctgccagacacactgtgacggctgcctgaagctagtgagtcgcggcgccgcgcactggtggttgggtcagtgccgcgcgccgatcggtcgttaccgcgaggcgctggtggccttcaggctggacggcgcgggtcagccctggttcgccggcttctgggtctttgaacagccgcgatgtcgatcttcacccccaccaaccagatccgcctaaccaatgtggccgtggtacggatgaagcgtgccgggaagcgcttcgaaatcgcctgctacaaaaacaaggtcgtcggctggcggagcggcgtggaaaaagacctcgatgaagttctgcagacccactcagtgtttgtaaatgtttctaaaggtcaggttgccaaaaaggaagatctcatcagtgcgtttggaacagatgaccaaactgaaatctgtaagcagattttgactaaaggagaagttcaagtatcagataaagaaagacacacacaactggagcagatgtttagggacattgcaactattgtggcagacaaatgtgtgaatcctgaaacaaagagaccatacaccgtgatccttattgagagagccatgaaggacatccactattcggtgaaaaccaacaagagtacaaaacagcaggctttggaagtgataaagcagttaaaagagaaaatgaagatagaacgtgctcacatgaggcttcggttcatccttccagtcaatgaaggcaagaagctgaaagaaaagctcaagccactgatcaaggtcatagaaagtgaagattatggccaacagttagaaatcgtatgtctgattgacccgggctgcttccgagaaattgatgagctaataaaaaaggaaactaaaggcaaaggttctttggaagtactcaatctgaaagatgtagaagaaggagatgagaaatttgaatgacacccatcaatctcttcacctctaaaacactaaagtgtttccgtttccgacggcactgtttcatgtctgtggtctgccaaatacttgcttaaactatttgacattttctatctttgtgttaacagtggacacagcaaggctttcctacataagtataataatgtgggaatgatttggttttaattataaactggggtctaaatcctaaagcaaaattgaaactccaagatgcaaagtccagagtggcattttgctactctgtctcatgccttgatagctttccaaaatgaaagttacttgaggcagctcttgtgggtgaaaagttatttgtacagtagagtaagattattaggggtatgtctatacaacaaaagggggggtctttcctaaaaaagaaaacatatgatgcttcatttctacttaatggaacttgtgttctgagggtcattatggtatcgtaatgtaaagcttggatgatgttcctgattatctgagaaacagatatagaaaaattgtgccggacttacctttcattgaacatgctgccataacttagattattcttggttaaaaaataaaagtcacttatttctaattcttaaagtttataatatatattaatatagctaaaattgtatgtaatcaataaaaccactcttatgtttattaaacaaaaaaaaaaaaaaaaaaaaaagaaaaaagggggggggntaaaaagtacacacggggggacacaagtttaggggacaccgagtgtttggacaaaagggcccaaatagggagggaataaaaaacagagacagggacggtaaacaggtgaatgggaaaaggtccgagatttgggggaac

SEQ ID NO: 72483 - DNA, 1693 bp, Homo sapiens
gggcagttcacttgaggccaggagttcgaggccagcctggccaacatgaaaccccatctctactaaaaatacaaagttagccgggtgtggtggcgcatgcctgtaatcccagttactcaggaggctgaggcgggagaatcacttgaacccgggaggctgaggttacagtgagccgagatcgcgccattgcactccagcctgggcaaaaacagtgaaattccatctaggggcgggggttggggggtaagaaaaagaaaactgccctctacactaaaggtcatcagggggatttgttgtgtcttgccgttcatgttgttgccatctcgtatttaaatgtaaatgcatgtccaagtttcaagtatattcacataggactttctctcctgccctcacaagggaaaaagacctcgatgaagttctgcagacccactcagtgtttgtaaatgtttctaaaggtcaggttgccaaaaaggaagatctcatcagtgcgtttggaacagatgaccaaactgaaatctgtaagcagattttgactaaaggagaagttcaagtatcagataaagaaagacacacacaactggagcagatgtttagggacattgcaactattgtggcagacaaatgtgtgaatcctgaaacaaagagaccatacaccgtgatccttattgagagagccatgaaggacatccactattcggtgaaaaccaacaagagtacaaaacagcaggctttggaagtgataaagcagttaaaagagaaaatgaagatagaacgtgctcacatgaggcttcggttcatccttccagtcaatgaaggcaagaagctgaaagaaaagctcaagccactgatcaaggtcatagaaagtgaagattatggccaacagttagaaatcgtatgtctgattgacccgggctgcttccgagaaattgatgagctaataaaaaaggaaactaaaggcaaaggttctttggaagtactcaatctgaaagatgtagaagaaggagatgagaaatttgaatgacacccatcaatctcttcacctctaaaacactaaagtgtttccgtttccgacggcactgtttcatgtctgtggtctgccaaatacttgcttaaactatttgacattttctatctttgtgttaacagtggacacagcaaggctttcctacataagtataataatgtgggaatgatttggttttaattataaactggggtctaaatcctaaagcaaaattgaaactccaagatgcaaagtccagagtggcattttgctactctgtctcatgccttgatagctttccaaaatgaaagttacttgaggcagctcttgtgggtgaaaagttatttgtacagtagagtaagattattaggggtatgtctatacaacaaaagggggggtctttcctaaaaaagaaaacatatgatgcttcatttctacttaatggaacttgtgttctgagggtcattatggtatcgtaatgtaaagcttggatgatgttcctgattatctgagaaacagatatagaaaaattgtgccggacttacctttcattgaacatgctgccataacttagattattcttggttaaaaaataaaagtcacttatttctaattcttaaagtttataatatatattaatatagctaaaattgtatgtaatcaataaaaccactcttatgtttattaaac

SEQ ID NO: 72484 - DNA, 1035 bp, Homo sapiens
  misc_feature (48)..(48): n is a, c, g, or t
  misc_feature (94)..(94): n is a, c, g, or t
ggtctgtctgccagtaattagtgccgaaaactggaagccagcaaccanaaccgaccaagtaatccagtccctcatagcactggtgaatgacccncagcctgagcacccgcttcgggctgacctagctgaagaatactctaaggaccgtaaaaaattctgtaagaatgctgaagtgtcaacgtgccactgatcaaggtcatagaaagtgaagattatggccaacagttagaaatcgtatgtctgattgacccgggctgcttccgagaaattgatgagctaataaaaaaggaaactaaaggcaaaggttctttggaagtactcaatctgaaagatgtagaagaaggagatgagaaatttgaatgacacccatcaatctcttcacctctaaaacactaaagtgtttccgtttccgacggcactgtttcatgtctgtggtctgccaaatacttgcttaaactatttgacattttctatctttgtgttaacagtggacacagcaaggctttcctacataagtataataatgtgggaatgatttggttttaattataaactggggtctaaatcctaaagcaaaattgaaactccaagatgcaaagtccagagtggcattttgctactctgtctcatgccttgatagctttccaaaatgaaagttacttgaggcagctcttgtgggtgaaaagttatttgtacagtagagtaagattattaggggtatgtctatacaacaaaagggggggtctttcctaaaaaagaaaacatatgatgcttcatttctacttaatggaacttgtgttctgagggtcattatggtatcgtaatgtaaagcttggatgatgttcctgattatctgagaaacagatatagaaaaattgtgccggacttacctttcattgaacatgctgccataacttagattattcttggttaaaaaataaaagtcacttatttctaattcttaaagtttataatatatattaatatagctaaaattgtatgtaatcaataaaaccactcttatgtttattaaac

SEQ ID NO: 72485 - DNA, 829 bp, Homo sapiens
cgtcccgtgtacgggaggtggagaaatcgtatgtctgattgacccgggctgcttccgagaaattgatgagctaataaaaaaggaaactaaaggcaaaggttctttggaagtactcaatctgaaagatgtagaagaaggagatgagaaatttgaatgacacccatcaatctcttcacctctaaaacactaaagtgtttccgtttccgacggcactgtttcatgtctgtggtctgccaaatacttgcttaaactatttgacattttctatctttgtgttaacagtggacacagcaaggctttcctacataagtataataatgtgggaatgatttggttttaattataaactggggtctaaatcctaaagcaaaattgaaactccaagatgcaaagtccagagtggcattttgctactctgtctcatgccttgatagctttccaaaatgaaagttacttgaggcagctcttgtgggtgaaaagttatttgtacagtagagtaagattattaggggtatgtctatacaacaaaagggggggtctttcctaaaaaagaaaacatatgatgcttcatttctacttaatggaacttgtgttctgagggtcattatggtatcgtaatgtaaagcttggatgatgttcctgattatctgagaaacagatatagaaaaattgtgccggacttacctttcattgaacatgctgccataacttagattattcttggttaaaaaataaaagtcacttatttctaattcttaaagtttataatatatattaatatagctaaaattgtatgtaatcaataaaaccactcttatgtttattaaac

SEQ ID NO: 72486 - DNA, 722 bp, Homo sapiens
actacggctaggtacgaggctgggtgttgggagatgagaaatttgaatgacacccatcaatctcttcacctctaaaacactaaagtgtttccgtttccgacggcactgtttcatgtctgtggtctgccaaatacttgcttaaactatttgacattttctatctttgtgttaacagtggacacagcaaggctttcctacataagtataataatgtgggaatgatttggttttaattataaactggggtctaaatcctaaagcaaaattgaaactccaagatgcaaagtccagagtggcattttgctactctgtctcatgccttgatagctttccaaaatgaaagttacttgaggcagctcttgtgggtgaaaagttatttgtacagtagagtaagattattaggggtatgtctatacaacaaaagggggggtctttcctaaaaaagaaaacatatgatgcttcatttctacttaatggaacttgtgttctgagggtcattatggtatcgtaatgtaaagcttggatgatgttcctgattatctgagaaacagatatagaaaaattgtgccggacttacctttcattgaacatgctgccataacttagattattcttggttaaaaaataaaagtcacttatttctaattcttaaagtttataatatatattaatatagctaaaattgtatgtaatcaataaaaccactcttatgtttattaaac

SEQ ID NO: 72487 - DNA, 901 bp, Homo sapiens
  misc_feature (544)..(544): n is a, c, g, or t
  misc_feature (548)..(548): n is a, c, g, or t
ctttttgggcgtggaaagatggcgtaaaaagccacaatacgcaggcgtcatcgctcacttttcccctcccggcttctgctccacctgacgcctgcgcagtaagtaagcctgccagacacactgtgacggctgcctgaagctagtgagtcgcggcgccgcgcactggtggttgggtcagtgccgcgcgccgatcggtcgttaccgcgaggcgctggtggccttcaggctggacggcgcgggtcagccctggttcgccggcttctgggtctttgaacagccgcgatgtcgatcttcacccccaccaaccagatccgcctaaccaatgtggccgtggtacggatgaagcgtgccgggaagcgcttcgaaatcgcctgctacaaaaacaaggtcgtcggctggcggagcggcgtggaaaaagacctcgatgaagttctgcagacccactcagtgtttgtaaatgtttctaaaggtcaggttgccaaaaaggaagatctcatcagtgcgtttggaacagatgaccaaactgaaatctgtaagcagattntganaaaggagaagtcaagtattcacgatccaaaaggacaagacacatcaacaaaatggggagacaggaatggtttaggggggaaccattgggcaccaaactggtggggctggacccccacatggtcgttgacgcatcccttgacaccataagcaagaacccatcacacccgtggaatcctttgacctggaaagaagcccccggcacagtgctaacatcccaagaaaatacgggaccgcaacgaccctacgacgacagggacccaaaaaccagcacgcacacgtgcaagatgtcatactagacgagatcacaacaagaaatagcaaccaacacaaagggacccccaacaaagcgctg

SEQ ID NO: 72488 - DNA, 166 bp, Homo sapiens
gtgaagattatggccaacagttagaaatcgtaagagtcaaatattttctttgcttcatgttacctaaatattgtattctctagtaataaatttgtagcaaacatttagatgttgtaaacgtcagatattttcttttcttttttttttttgagatggagtctcgctc

SEQ ID NO: 72489 - DNA, 836 bp, Homo sapiens
  misc_feature (766)..(766): n is a, c, g, or t
  misc_feature (772)..(772): n is a, c, g, or t
  misc_feature (807)..(807): n is a, c, g, or t
ctttttgggcgtggaaagatggcgtaaaaagccacaatacgcaggcgtcatcgctcacttttcccctcccggcttctgctccacctgacgcctgcgcagtaagtaagcctgccagacacactgtgacggctgcctgaagctagtgagtcgcggcgccgcgcactggtggttgggtcagtgccgcgcgccgatcggtcgttaccgcgaggcgctggtggccttcaggctggacggcgcgggtcagccctggttcgccggcttctgggtctttgaacagccgcgatgtcgatcttcacccccaccaaccagatccgcctaaccaatgtggccgtggtacggatgaagcgtgccgggaagcgcttcgaaatcgcctgctacaaaaacaaggtcgtcggctggcggagcggcgtggaaaaagacctcgatgaagttctgcagacccactcagtgtttgtaaatgtttctaaaggtcaggttgccaaaaaggaagatctcatcagtgcgtttggaacagatgaccaaactgaaatctgtaagcagattttgactaaaggagaagttcaagtatcagataaagaaagacacacacaactggagcagatgtttagggacattgcaactattgtggcagacaaatgtgtgaatcctgaaacaaagagaccatacaccgtgatccttattgagagagccatgaaggacatcatatcgtgaaccacagatacaacagcagcttggagtgataagcagtaaagagaaatgagatagnacgtgncacagagctcgtcatctccatcatgagcagagtgnagaagtcagcatgtcagtcaagatgagat

SEQ ID NO: 72490 - DNA, 1738 bp, Homo sapiens
ctttttgggcgtggaaagatggcgtaaaaagccacaatacgcaggcgtcatcgctcacttttcccctcccggcttctgctccacctgacgcctgcgcagtaagtaagcctgccagacacactgtgacggctgcctgaagctagtgagtcgcggcgccgcgcactggtggttgggtcagtgccgcgcgccgatcggtcgttaccgcgaggcgctggtggccttcaggctggacggcgcgggtcagccctggttcgccggcttctgggtctttgaacagccgcgatgtcgatcttcacccccaccaaccagatccgcctaaccaatgtggccgtggtacggatgaagcgtgccgggaagcgcttcgaaatcgcctgctacaaaaacaaggtcgtcggctggcggagcggcgtggaaaaagacctcgatgaagttctgcagacccactcagtgtttgtaaatgtttctaaaggtcaggttgccaaaaaggaagatctcatcagtgcgtttggaacagatgaccaaactgaaatctgtaagcagattttgactaaaggagaagttcaagtatcagataaagaaagacacacacaactggagcagatgtttagggacattgcaactattgtggcagacaaatgtgtgaatcctgaaacaaagagaccatacaccgtgatccttattgagagagccatgaaggacatccactattcggtgaaaaccaacaagagtacaaaacagcaggctttggaagtgataaagcagttaaaagagaaaatgaagatagaacgtgctcacatgaggcttcggttcatccttccagtcaatgaaggcaagaagctgaaagaaaagctcaagccactgatcaaggtcatagaaagtgaagattatggccaacagttagaaatcgtatgtctgattgacccgggctgcttccgagaaattgatgagctaataaaaaaggaaactaaaggcaaaggttctttggaagtactcaatctgaaagatgtagaagaaggagatgagaaatttgaatgacacccatcaatctcttcacctctaaaacactaaagtgtttccgtttccgacggcactgtttcatgtctgtggtctgccaaatacttgcttaaactatttgacattttctatctttgtgttaacagtggacacagcaaggctttcctacataagtataataatgtgggaatgatttggttttaattataaactggggtctaaatcctaaagcaaaattgaaactccaagatgcaaagtccagagtggcattttgctactctgtctcatgccttgatagctttccaaaatgaaagttacttgaggcagctcttgtgggtgaaaagttatttgtacagtagagtaagattattaggggtatgtctatacaacaaaagggggggtctttcctaaaaaagaaaacatatgatgcttcatttctacttaatggaacttgtgttctgagggtcattatggtatcgtaatgtaaagcttggatgatgttcctgattatctgagaaacagatatagaaaaattgtgccggacttacctttcattgaacatgctgccataacttagattattcttggttaaaaaataaaagtcacttatttctaattcttaaagtttataatatatattaatatagctaaaattgtatgtaatcaataaaaccactcttatgtttattaaacctatggcttgtgtttctagacaacttcctaa

SEQ ID NO: 72491 - DNA, 1178 bp, Homo sapiens
ctttttgggcgtggaaagatggcgtaaaaagccacaatacgcaggcgtcatcgctcacttttcccctcccggcttctgctccacctgacgcctgcgcagtaagtaagcctgccagacacactgtgacggctgcctgaagctagtgagtcgcggcgccgcgcactggtggttgggtcagtgccgcgcgccgatcggtcgttaccgcgaggcgctggtggccttcaggctggacggcgcgggtcagccctggttcgccggcttctgggtctttgaacagccgcgatgtcgatcttcacccccaccaaccagatccgcctaaccaatgtggccgtggtacggatgaagcgtgccgggaagcgcttcgaaatcgcctgctacaaaaacaaggtcgtcggctggcggagcggcgtggaaaaagacctcgatgaagttctgcagacccactcagtgtttgtaaatgtttctaaaggtcaggttgccaaaaaggaagatctcatcagtgcgtttggaacagatgaccaaactgaaatctgtaagcagattttgactaaaggagaagttcaagtatcagataaagaaagacacacacaactggagcagatgtttagggacattgcaactattgtggcagacaaatgtgtgaatcctgaaacaaagagaccatacaccgtgatccttattgagagagccatgaaggacatccactattcggtgaaaaccaacaagagtacaaaacagcaggctttggaagtgataaagcagttaaaagagaaaatgaagatagaacgtgctcacatgaggcttcggttcatccttccagtcaatgaaggcaagaagctgaaagaaaagctcaagccactgatcaaggtcatagaaagtgaagattatggccaacagttagaaatcgtatgtctgattgacccgggctgcttccgagaaattgatgagctaataaaaaaggaaactaactgtaaaacagcctttggcaggtccttaggtggtattccgggataaagcattgtcatcaggagatgatagctcccatacatgttattttcttgctcttgaagaccttgcagtgggacaatatgtggaggtggaagatcctgatcctgggtaggcctaggctaatgtgtgtgttcgtgtcttcatttttaacaaaagttaaaaatacctac

SEQ ID NO: 72492 - DNA, 209 bp, Homo sapiens
gaagttcaagtatcagataaagaaagacacacacaactggagcagatgtttagggacattgcaactattgtggcagacaaatgtgtgaatcctgaaacaaagagaccatacaccgtgatccttattgagagagccatgaaggacatccactattcggtgaaaaccaacaagagtacaaaacagcaggtgagtggtttctcatgtcatca

SEQ ID NO: 72493 - DNA, 1803 bp, Homo sapiens
tctcttaggggaaatgaaatcctgttaaaatttgtctctggccacctaggcgaaaccctaacttcttcactttggaatgctaaccccatttggagctggtgtctcctgggtggctaccctcaagccttacgctggaataaactctatccttaatcatatttccagaacctcactatttaaggttgacaggagagggaagcggtgatgtcttgagataaagctgaataaagtttctcaagaaaaaaagggaaaggaacctctaagctgtacgttgttttctaactctagggagttagaggtgaagtaggaacttgaagttggaagtgttgagttggacagccctcatctctaggcaatactttcataaagtggaaaaacgggggaagaggacgaaggctagggagagacgcagggatccacccaacccagtcctgagtttcccactcgctcttggagttgagtacaaagagcgctccaaagccccttctcctgtgctcagcccagtgctccggtgggtcaggtctccggaatgcgtaaacaaaagcaaacagctgagcggcggagggcgcaggcgacagatgtgggtgttccctgagaatgtgtggcgacttcccggagcagcgggtctgtgaggcaacgatggaagacactgcgctccacagcatagcaggaggccccgccccgtgtggcgccaagtaaaagataattcctcagaagccgtcggccaccggcgcttcgcctcgtcccgcgccaggcccagcctctcccccagaccaccggtgccatgcggattccccaggcgggaccccagctcacgaggcccactggccgaagctccccacaggatagagagccgctcctgcgaggccaagcttccgagaggcggcctgcgcctagcacgcaggcgcggaaagctgggcgccagccttaaactgactcccgccacctgcctcgggccgcgccgtccaccgtttactttcgaacgagcccagcaatagttcccattggccgatgccttgcagttgaatgttgcctgcagactgcgcctgcgctgcgaggctccgcgaggccccgcccggtctgggcacctgaagcccttcggggcagaggagggcggggactcggggcggctctcagcatccgcctggagctcgtggcgctgtgtttccgtgctgtggagttgcctggtccgcttcctccccgcggaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaattagtttgtggtcattgccttaccataggtcaacatcatggtcatcctatagatgaccttcaaagtgcctatttgaaagaaaaggacactcctcaaaaactgcttgaacagttgactgacacacactggacagatcttacccatcttattgaaaagctgaaagaacaaaaatctcattctgagaaaatgatccaaggcgataaggaagctgttctccagtattttaaggagcttaatgatacattagaacaga

SEQ ID NO: 72494 - DNA, 1873 bp, Homo sapiens
tctcttaggggaaatgaaatcctgttaaaatttgtctctggccacctaggcgaaaccctaacttcttcactttggaatgctaaccccatttggagctggtgtctcctgggtggctaccctcaagccttacgctggaataaactctatccttaatcatatttccagaacctcactatttaaggttgacaggagagggaagcggtgatgtcttgagataaagctgaataaagtttctcaagaaaaaaagggaaaggaacctctaagctgtacgttgttttctaactctagggagttagaggtgaagtaggaacttgaagttggaagtgttgagttggacagccctcatctctaggcaatactttcataaagtggaaaaacgggggaagaggacgaaggctagggagagacgcagggatccacccaacccagtcctgagtttcccactcgctcttggagttgagtacaaagagcgctccaaagccccttctcctgtgctcagcccagtgctccggtgggtcaggtctccggaatgcgtaaacaaaagcaaacagctgagcggcggagggcgcaggcgacagatgtgggtgttccctgagaatgtgtggcgacttcccggagcagcgggtctgtgaggcaacgatggaagacactgcgctccacagcatagcaggaggccccgccccgtgtggcgccaagtaaaagataattcctcagaagccgtcggccaccggcgcttcgcctcgtcccgcgccaggcccagcctctcccccagaccaccggtgccatgcggattccccaggcgggaccccagctcacgaggcccactggccgaagctccccacaggatagagagccgctcctgcgaggccaagcttccgagaggcggcctgcgcctagcacgcaggcgcggaaagctgggcgccagccttaaactgactcccgccacctgcctcgggccgcgccgtccaccgtttactttcgaacgagcccagcaatagttcccattggccgatgccttgcagttgaatgttgcctgcagactgcgcctgcgctgcgaggctccgcgaggccccgcccggtctgggcacctgaagcccttcggggcagaggagggcggggactcggggcggctctcagcatccgcctggagctcgtggcgctgtgtttccgtgctgtggagttgcctggtccgcttcctccccgcgaataagaataaaagattctggaggagttggagaagagtgtattcagcccccaaaccacgagatcaacaaagaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaattagtttgtggtcattgccttaccataggtcaacatcatggtcatcctatagatgaccttcaaagtgcctatttgaaagaaaaggacactcctcaaaaactgcttgaacagttgactgacacacactggacagatcttacccatcttattgaaaagctgaaagaacaaaaatctcattctgagaaaatgatccaaggcgataaggaagctgttctccagtattttaaggagcttaatgatacattagaacaga

SEQ ID NO: 72495 - DNA, 2118 bp, Homo sapiens
tctcttaggggaaatgaaatcctgttaaaatttgtctctggccacctaggcgaaaccctaacttcttcactttggaatgctaaccccatttggagctggtgtctcctgggtggctaccctcaagccttacgctggaataaactctatccttaatcatatttccagaacctcactatttaaggttgacaggagagggaagcggtgatgtcttgagataaagctgaataaagtttctcaagaaaaaaagggaaaggaacctctaagctgtacgttgttttctaactctagggagttagaggtgaagtaggaacttgaagttggaagtgttgagttggacagccctcatctctaggcaatactttcataaagtggaaaaacgggggaagaggacgaaggctagggagagacgcagggatccacccaacccagtcctgagtttcccactcgctcttggagttgagtacaaagagcgctccaaagccccttctcctgtgctcagcccagtgctccggtgggtcaggtctccggaatgcgtaaacaaaagcaaacagctgagcggcggagggcgcaggcgacagatgtgggtgttccctgagaatgtgtggcgacttcccggagcagcgggtctgtgaggcaacgatggaagacactgcgctccacagcatagcaggaggccccgccccgtgtggcgccaagtaaaagataattcctcagaagccgtcggccaccggcgcttcgcctcgtcccgcgccaggcccagcctctcccccagaccaccggtgccatgcggattccccaggcgggaccccagctcacgaggcccactggccgaagctccccacaggatagagagccgctcctgcgaggccaagcttccgagaggcggcctgcgcctagcacgcaggcgcggaaagctgggcgccagccttaaactgactcccgccacctgcctcgggccgcgccgtccaccgtttactttcgaacgagcccagcaatagttcccattggccgatgccttgcagttgaatgttgcctgcagactgcgcctgcgctgcgaggctccgcgaggccccgcccggtctgggcacctgaagcccttcggggcagaggagggcggggactcggggcggctctcagcatccgcctggagctcgtggcgctgtgtttccgtgctgtggagttgcctggtccgcttcctccccgcggtgagtctaaggacctttacggatgcggagaaggtggttctgagtcctttttcttttcctgtagcacagtctggtgtgcctagtgtgttgggcggggagtcctgggggcgcgacgatggagggagtggcttgggacctgcactcattccctcttgtcccatactggagtttggggagccactttcccgtccctccactgtggagctgcgttcctgtgagggaggaggccctctgtggtggcgaggaataagaataaaagattctggaggagttggagaagagtgtattcagcccccaaaccacgagatcaacaaagaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaattagtttgtggtcattgccttaccataggtcaacatcatggtcatcctatagatgaccttcaaagtgcctatttgaaagaaaaggacactcctcaaaaactgcttgaacagttgactgacacacactggacagatcttacccatcttattgaaaagctgaaagaacaaaaatctcattctgagaaaatgatccaaggcgataaggaagctgttctccagtattttaaggagcttaatgatacattagaacaga

SEQ ID NO: 72496 - DNA, 1688 bp, Homo sapiens
  misc_feature (224)..(224): n is a, c, g, or t
  misc_feature (300)..(300): n is a, c, g, or t
  misc_feature (1173)..(1173): n is a, c, g, or t
  misc_feature (1648)..(1648): n is a, c, g, or t
  misc_feature (1688)..(1688): n is a, c, g, or t
gctagcttcacccagtggctcctgcaccggggctgcaggtggagctgcctgccagtcccacgctgtgggcctgtactcctcagcccttgggtggtcgatgggactgggcgccgtggagcagggggctgcactcgtagggtaggctcctcggccgcacaggagcccacggagcgggggaggctcaggcatggcgggctgcaggtctcaagccctgtcccgcaggnaggcagccaaggcccggtgacaaatcgagtgcagtgcccgtgggccagcactgctgggggacccagtacacactcngcagccgctggcccgggtgctaagcccctcattgccctgggccaacagggccggccggctgctccgagtgcggggcccaccaagcccacgcccacccggaactccagctggcccgcaagccccacgcgcagccccggttcccgctggcgcttcttcctccacacctccctgcaagctgagggagccggctccagccttggccagcccagaaaggggctcccacagtgcagtggtgggctgaagggctcatcaagtgccaccaaagtgggagcccaggcagaggaggcgctgagagcgagccagggctgtgaggactgccagcattctgtcacctctcaataggataaataacttgtgagagaactacttctgcagtttttagtgtttttgttttgctttgttttttgtttgtctttggtactagattaataaaaatttagatcttaggaccctacagatcatcctgtataacagtgttttatacagaggcataaaaaggaaagtgctttgcctgaagccacatagtttatgagtctacaataaaactcatatacgccgactcctctatcagtgttcttttcactggaacaatactttcttatcatgaaccttataccttttcctcaaagaaaataggtacagttatttgattagcaattgtctcctcattaatctctagggactatttggtcacttttctattctccatgcctgtcagctggggattgccttcagctcttagaggtcacactcagctgctagccatgtagacctgttaacattactacttatttcttcaaggccagctagagagacaaggtctctatagtatgtctgtatcaagatagagtcttatgtaatgtaacataaccntcagagtgattttccatcatctttgctttactttgttggttagaagcaagcctcatgtcttgcctacactcaaggtgacaaatggtcataaacatcaggaggtggggatcatgaggaatcaccctagagtttgtctgccatagtctatattaaacttttagaaacttacattaaacttatataaatgttaccttgatatatcttcgtatacattattcatttgagctttacataattcacccattttttaattcatttatctattcattctgcaaacattcatgttaagtcaattatgtactaggtagtacgttaggtttgggggatagacattaaaaccaagactcagtaagcttaaacaacttccagtttagtgcaagaattcttagtctgtgttacttggtccaagaggaccacaagtagatttttaggaatttgtgaggttcctgaaattgttttgcaattttgttctatnagctatgaagcagtgatgctatgaagattttataaaccan

SEQ ID NO: 72497 - DNA, 376 bp, Homo sapiens
ctatcattgatggacatttgggttggtgcaagtctttgctattgtgaatagtgccgcaataaacatgtgcgtgcatgtgtctttatagcagcatgatttataatcctttcagtatatacccagtaatgggatggctgggtcaaatggtatttctagttctagatccttgaggaatcgccacactgtcttccacagtgggacttttctaacgtgcacattttcatagcaagcaagaggagtggcctccagtgtgaggattctagattgcacccaaacaggcagaatttctactttacagaccttctggaagactgtcagctttagacctacccaggcattccaaatctcttacaggatttggaactcttaggctctg

SEQ ID NO: 72498 - DNA, 296 bp, Homo sapiens
gagaatgtgagatgtgaaaattttccaactgaaaaaaggctcacatttctctttataatggaaaattgctcttagccaactatgactctatcacaccaggatctaggagacatgatgagaaatgcttggaaggatcagcaccaaaaactcagtaaattaggcaagatctttcaggttcctatattcagacaaagaacacttctggcaggaagaacaatactatggcagactctaggaaatgtgaaataaatacacaactttgattcaaaaaagactaaggctactctttcatacct

SEQ ID NO: 72499 - DNA, 135 bp, Homo sapiens
aatgatcacttcataatgccacaaactcacagcaggcaaaactaattttacacaatatgaaaacagattttatttatttaaaaggaatattaaaaaaacaacttttttgacaccagctgctgggaaataaataga

SEQ ID NO: 72500 - DNA, 358 bp, Homo sapiens
gaggaacctccaaactgttctccatagtggttgtaaagttgcaaatattgacagtagttactcaagtggtgccaaactacaggagaaggcctacttgtatttggcaaaaccaacctttacccacgtactgaatctgataacgtggcttttgctcaaaatccaactctgatgtggtaaaaaccttaattgaaagtggaccatagctcagtgcttctcaaactctaatgcgggtaagaatgttctgggtgtctcgttaaaatgcagattctgattcagctggcctggggtgggacctataagtctgcatttctgacaagcttttagagggtgctgaagctttagctctacagctgtgctt

SEQ ID NO: 72501 - DNA, 302 bp, Homo sapiens
atatttgaaaagatcttcaccaaagatatatggatagtaagtaaatatatgaaaggttttcactgttaatgattaaaggaaatgcaatcttgtacatgaatgtttataacagcatcattcataagagccaaaaggtagaaacaatccaaatgttcatcaactgatgaatgaatacacaaaacatagtattatctatataatggaatattacttggccataaaaagaaatgaactgggccaggcgcaatgacttacgcctgtaatcccagcactttgggaggctgaggtgggcggactgcttg

SEQ ID NO: 72502 - DNA, 2441 bp, Homo sapiens
aggcttaagctgccagccagagagggagtcatttcattggcgtttgagtcagcaaagaagtcaagatggccaaagttccagacatgtttgaagacctgaagaactgttacagtgaaaatgaagaagacagttcctccattgatcatctgtctctgaatcagaaatccttctatcatgtaagctatggcccactccatgaaggctgcatggatcaatctgtgtctctgagtatctctgaaacctctaaaacatccaagcttaccttcaaggagagcatggtggtagtagcaaccaacgggaaggttctgaagaagagacggttgagtttaagccaatccatcactgatgatgacctggaggccatcgccaatgactcagaggaagaaatcatcaagcctaggtcagcaccttttagcttcctgagcaatgtgaaatacaactttatgaggatcatcaaatacgaattcatcctgaatgacgccctcaatcaaagtataattcgagccaatgatcagtacctcacggctgctgcattacataatctggatgaagcagtgaaatttgacatgggtgcttataagtcatcaaaggatgatgctaaaattaccgtgattctaagaatctcaaaaactcaattgtatgtgactgcccaagatgaagaccaaccagtgctgctgaaggagatgcctgagatacccaaaaccatcacaggtagtgagaccaacctcctcttcttctgggaaactcacggcactaagaactatttcacatcagttgcccatccaaacttgtttattgccacaaagcaagactactgggtgtgcttggcaggggggccaccctctatcactgactttcagatactggaaaaccaggcgtaggtctggagtctcacttgtctcacttgtgcagtgttgacagttcatatgtaccatgtacatgaagaagctaaatcctttactgttagtcatttgctgagcatgtactgagccttgtaattctaaatgaatgtttacactctttgtaagagtggaaccaacactaacatataatgttgttatttaaagaacaccctatattttgcatagtaccaatcattttaattattattcttcataacaattttaggaggaccagagctactgactatggctaccaaaaagactctacccatattacagatgggcaaattaaggcataagaaaactaagaaatatgcacaatagcagttgaaacaagaagccacagacctaggatttcatgatttcatttcaactgtttgccttctacttttaagttgctgatgaactcttaatcaaatagcataagtttctgggacctcagttttatcattttcaaaatggagggaataatacctaagccttcctgccgcaacagttttttatgctaatcagggaggtcattttggtaaaatacttctcgaagccgagcctcaagatgaaggcaaagcacgaaatgttattttttaattattatttatatatgtatttataaatatatttaagataattataatatactatatttatgggaaccccttcatcctctgagtgtgaccaggcatcctccacaatagcagacagtgttttctgggataagtaagtttgatttcattaatacagggcattttggtccaagttgtgcttatcccatagccaggaaactctgcattctagtacttgggagacctgtaatcatataataaatgtacattaattaccttgagccagtaattggtccgatctttgactcttttgccattaaacttacctgggcattcttgtttcattcaattccacctgcaatcaagtcctacaagctaaaattagatgaactcaactttgacaaccatgagaccactgttatcaaagttgagttcatctaattttagcttgtagagacgggatttcaccatcttggccgtgctggtctcgaacttctgacctcgtgatccacccgcctcggcctcccaaagtgctgggattacaggcgtgagccatcgcgcccggcctggagtttctactgtgcaccaggcactacctttacatgtattgttttatttaatcctcagtcagccgtgtttggtaggtgcagttagtatatttccattttcatctgcgcaaacagattcaggaactttgtaatttacataaggtcacattcatcctaattcacaaaatcaagatttcacacctattcctttttctttccagtgcctgtgctttttctctcataccaaggagaagtaataagcctaacgttttaaacctcacaaaagtacatacagaaaagtaaatagcctaattttgcaactaatacaaatggcgctgtacttctttggtgatggtagatttataatttttgaagtatggtagattcaaatgaaccactgaaaaggcatttagtttcttgtcccaaat

SEQ ID NO: 72503 - DNA, 2022 bp, Homo sapiens
aggcttaagctgccagccagagagggagtcatttcattggcgtttgagtcagcaaagaagtcaagatggccaaagttccagacatgtttgaagacctgaagaactgttacagtgaaaatgaagaagacagttcctccattgatcatctgtctctgaatcagaaatccttctatcatgtaagctatggcccactccatgaaggctgcatggatcaatctgtgtctctgagtatctctgaaacctctaaaacatccaagcttaccttcaaggagagcatggtggtagtagcaaccaacgggaaggttctgaagaagagacggttgagtttaagccaatccatcactgatgatgacctggaggccatcgccaatgactcagaggaagaaatcatcaagcctaggtcagcaccttttagcttcctgagcaatgtgaaatacaactttatgaggatcatcaaatacgaattcatcctgaatgacgccctcaatcaaagtataattcgagccaatgatcagtacctcacggctgctgcattacataatctggatgaagcagtgaaatttgacatgggtgcttataagtcatcaaaggatgatgctaaaattaccgtgattctaagaatctcaaaaactcaattgtatgtgactgcccaagatgaagaccaaccagtgctgctgaaggagatgcctgagatacccaaaaccatcacaggtagtgagaccaacctcctcttcttctgggaaactcacggcactaagaactatttcacatcagttgcccatccaaacttgtttattgccacaaagcaagactactgggtgtgcttggcaggggggccaccctctatcactgactttcagatactggaaaaccaggcgtaggtctggagtctcacttgtctcacttgtgcagtgttgacagttcatatgtaccatgtacatgaagaagctaaatcctttactgttagtcatttgctgagcatgtactgagccttgtaattctaaatgaatgtttacactctttgtaagagtggaaccaacactaacatataatgttgttatttaaagaacaccctatattttgcatagtaccaatcattttaattattattcttcataacaattttaggaggaccagagctactgactatggctaccaaaaagactctacccatattacagatgggcaaattaaggcataagaaaactaagaaatatgcacaatagcagttgaaacaagaagccacagacctaggatttcatgatttcatttcaactgtttgccttctacttttaagttgctgatgaactcttaatcaaatagcataagtttctgggacctcagttttatcattttcaaaatggagggaataatacctaagccttcctgccgcaacagttttttatgctaatcagggaggtcattttggtaaaatacttctcgaagccgagcctcaagatgaaggcaaagcacgaaatgttattttttaattattatttatatatgtatttataaatatatttaagataattataatatactatatttatgggaaccccttcatcctctgagtgtgaccaggcatcctccacaatagcagacagtgttttctgggataagtaagtttgatttcattaatacagggcattttggtccaagttgtgcttatcccatagccaggaaactctgcattctagtacttgggagacctgtaatcatataataaatgtacattaattaccttgagccagtaattggtccgatctttgactcttttgccattaaacttacctgggcattcttgtttcattcaattccacctgcaatcaagtcctacaagctaaaattagatgaactcaactttgacaaccatgagaccactgttatcaaaactttcttttctggaatgtaatcaatgtttcttctaggttctaaaaattgtgatcagaccataatgttacattattatcaacaatagtgattgatagagtgttatcagtcataactaaataaagcttgcaa

SEQ ID NO: 72504 - DNA, 2068 bp, Homo sapiens
aggcttaagctgccagccagagagggagtcatttcattggcgtttgagtcagcaaagaagtcaagatggccaaagttccagacatgtttgaagacctgaagaactgttacagtgaaaatgaagaagacagttcctccattgatcatctgtctctgaatcagaaatccttctatcatgtaagctatggcccactccatgaaggctgcatggatcaatctgtgtctctgagtatctctgaaacctctaaaacatccaagcttaccttcaaggagagcatggtggtagtagcaaccaacgggaaggttctgaagaagagacggttgagtttaagccaatccatcactgatgatgacctggaggccatcgccaatgactcagaggaagaaatcatcaagcctaggtcagcaccttttagcttcctgagcaatgtgaaatacaactttatgaggatcatcaaatacgaattcatcctgaatgacgccctcaatcaaagtataattcgagccaatgatcagtacctcacggctgctgcattacataatctggatgaagcagtgaaatttgacatgggtgcttataagtcatcaaaggatgatgctaaaattaccgtgattctaagaatctcaaaaactcaattgtatgtgactgcccaagatgaagaccaaccagtgctgctgaaggagatgcctgagatacccaaaaccatcacaggtagtgagaccaacctcctcttcttctgggaaactcacggcactaagaactatttcacatcagttgcccatccaaacttgtttattgccacaaagcaagactactgggtgtgcttggcaggggggccaccctctatcactgactttcagatactggaaaaccaggcgtaggtctggagtctcacttgtctcacttgtgcagtgttgacagttcatatgtaccatgtacatgaagaagctaaatcctttactgttagtcatttgctgagcatgtactgagccttgtaattctaaatgaatgtttacactctttgtaagagtggaaccaacactaacatataatgttgttatttaaagaacaccctatattttgcatagtaccaatcattttaattattattcttcataacaattttaggaggaccagagctactgactatggctaccaaaaagactctacccatattacagatgggcaaattaaggcataagaaaactaagaaatatgcacaatagcagttgaaacaagaagccacagacctaggatttcatgatttcatttcaactgtttgccttctacttttaagttgctgatgaactcttaatcaaatagcataagtttctgggacctcagttttatcattttcaaaatggagggaataatacctaagccttcctgccgcaacagttttttatgctaatcagggaggtcattttggtaaaatacttctcgaagccgagcctcaagatgaaggcaaagcacgaaatgttattttttaattattatttatatatgtatttataaatatatttaagataattataatatactatatttatgggaaccccttcatcctctgagtgtgaccaggcatcctccacaatagcagacagtgttttctgggataagtaagtttgatttcattaatacagggcattttggtccaagttgtgcttatcccatagccaggaaactctgcattctagtacttgggagacctgtaatcatataataaatgtacattaattaccttgagccagtaattggtccgatctttgactcttttgccattaaacttacctgggcattcttgtttcattcaattccacctgcaatcaagtcctacaagctaaaattagatgaactcaactttgacaaccatgagaccactgttatcaaaactttcttttctggaatgtaatcaatgtttcttctaggttctaaaaattgtgatcagaccataatgttacattattatcaacaatagtgattgatagagtgttatcagtcataactaaataaagcttgcaagtgagggagtcatttcattggcgtttgagtcagcaaagaagtcaag

SEQ ID NO: 72505 - DNA, 2750 bp, Homo sapiens
aggggcccacttagatgataccagagagcaagagagaggaactggggtttgcgaaccttgtggctttgtctgtttcctgtttcagcaaggctgctgtgcaaaaagaaagacggtaccaagaagggacgtgttaatggggcccagacctatggattgaaagcgtgtgctttacccatctgctgtcttgctccatctgagaccagagccaagatctgcccaggactggaatgctttcccgagtggcttgagttggagcctgggactaggagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccaggaactgcaggccaagattgaatgcctgcaaggggacagagacctgtgcagcttggatacccaggacctacaagatcaactaaaaaggtcagaggcagagaaactcaccctggtgaccagagtacagcagttgcagggtttgcttcaaaatcaatccttacagcttcaagaacaggagaaactcttaacaaagaaagatcaggctttgcccgtgtggagtccaaagtccttccctaacgaagtggagcctgagggtacagggaaggagaaagactgggatctcagagaccagctgcaaaagaagactttgcagctccaggccaaggaaaaggagtgcagagaactgcattcagaattagacaacctcagtgacgagtatctctcctgcctgcgtaagctgcagcactgtcgagaagagctgaaccagagccagcagctgcctcccagaaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccagattgttcctcagaactctcagtttattcctgaatggtgtattacattaacaagtatcacatatttaagcatactggtggtctactctcctcaaattcagttggaggcatataaacatgcagaaaagcccccagccctactttcctagcatgcagcacccacatagagcaggtatatttacaaggttaccatgcaagagtgtttggcttgtcttccatcaccctgcttttcctctatcatctccttccttctatcttttatccagtgaaaatgaaaacatctccactaagaggacttcctagtatagaaatggcaagtatgtactatctaccaatttgctactagcaccaccattacctatttacatgccctttgcatttgtggccaactgatctacagcattgtgccttagtgtattcaagacacttggaattggcagttgagatgattatttgccatccccaacctagagatgatcatttactgagtaccttctatatgggaggagagttaaagtcagagggccacagccggcagtgtgactatctcagaggagatgctgagat

SEQ ID NO: 72506 - DNA, 448 bp, Homo sapiens
agcagatgggaacatatttaataaccaaggttctaagcaaagttctgaaaagaaaactttttgtagtaaatatgctagcatagacaagttccttgtgttttccaacaggtttgcttcaaaatcaatccttacagcttcaagaacaggagaaactcttaacaaagaaaggtcagcaaatttattaccacaaattctaagatattgctcttctcttacctgcctagaggcagcgggatggactacatgacctcctggagtcccagccagttctgggagtctgttaagtccgggatgtgtgggagctttttaaggactgatcattggctctgaggacacttcaactagttagccttctatcttgaggtatataaactgtgaaaaagggtttctattctctctgaaagcacatgtctgtgttgaacatttcaataaatttattttgaactca

SEQ ID NO: 72507 - DNA, 3668 bp, Homo sapiens
agcagatgggaacatatttaataaccaaggttctaagcaaagttctgaaaagaaaactttttgtagtaaatatgctagcatagacaagttccttgtgttttccaacaggtttgcttcaaaatcaatccttacagcttcaagaacaggagaaactcttaacaaagaaaggtcagcaaatttattaccacaaattctaagatattgctcttctcttacctgcctagaggcagcgggatggactacatgacctcctggagtcccagccagttctgggagtctgttaagtccgggatgtgtgggagctttttaaggactgatcattggctctgaggacacttcaactagttagccttctatcttgaggtatataaactgtgaaaaagggtttctattctctctgaaagcacatgtctgtgttgaacatttcaataaatttattttgaactcaggatttcatgtcaatttttacacacttgattttccaaatcacatccaactccccagccccaaaccacatagcagtccagagtcaactcactgttagccctagagagtctactgtccatgtttcctgagaattcactgtgtatacagaggggcaatagctcctcacctgtccactacacacgaccttttgttttctcttcacaatcattgggcataatataatagataaggcagaaatttttatgctcacagagtatggataagaacatgaaagtctatggtgacacaaactaacaacacagctataacaacaatccaaaacttctgactcctagtccatgctcttttcaccaagactaagactgcagggtggctaaaaaaccatctttaaccatatgaagataaattttaggatatgactgccatcttcacaactttcaaatgaggacatcagggaaaagggattgtattaaagcatttaccaaacttatttgacaaactaggaagaatgtgacatacaaccaatgaaattcaattaagaagtattcactaaaactatctagcactagataggactggggatacaaagaaaagatcccaatcttgccctcaaggagctcagattccagctgtctgtccaagcttagcaggggcctactggaagttaacctttatgtcagagaatgccatcagtctagccaaaagcacgccctcccaagttccctcccctctccccactcctagtggtttcaccctcagggcccttcctcagaggtgtgggcctcactgtcaccaagaatctggctgcttttttagatcaggctttgcccgtgtggagtccaaagtccttccctaacgaagtggagcctgagggtacagggaaggagaaagactgggatctcagagaccagctgcaaaagaagactttgcagctccaggccaaggaaaaggaggtgagagggtgacctgagatagtgagggctcatttgcgaaatagcagagaaacctgggaggcagtcaaaaagcagggatttcaaagtttaagttgtgagtggataaccacagacattcatttgcctacataaagtgtctgtgcttttgggctgacttgtcaatcttttcccttccttatttataccaactcctattcaaggttttattaaatgattaccttttagaaagtcgaccaaaactcaaacacatttaataaaaatattaacttctcaatatgtcgtcccacattgagtatcttaagtctttatatgtctcttaaagagtaaaactcttcctttgtacatactcacaaacatacacatccccagaagtattgatatgcaactagctcctgggaaagaaacttgtactaaggtcacttctaggtcgtttgttctataagaacttcatttttcggtgtctctcatttgcaaagcacttgcacgtaaagtcatataaaagaacttaaatgtataaaatgtaatactataatatgcattactgtcaatcatttaaatgaacacattccagacaatgtaagacagtcaaaagacaaactcaaatccctgagaatggctgggaagggaagatggtggtaaaaattccaaatgagtgaaacttacaaagggcagtctcccctgcctgggctctgtcctagacagaagtgacagtgatgactttggtgatgttctccccagtgcagagaactgcattcagaattagacaacctcagtgacgagtatctctcctgcctgcgtaagctgcagcactgtcgagaagagctgaaccagagccagcagctgcctcccagagtaagagggtctctccttcccataaagccctggatgatgggacgattccttctttaaccaagttttgcacataaaatatatcagcccacgccaacaactggccatcctgtcccactgtgcttggtttatactatactgacattatggcaaccattgaaaaaaacactggctcgtccatcaaagcccaactttcacagaactctcaatgccagaaggaaagacttactcttagctaaagtatgaaagggtgttcttttagccgatgataagcatggtggcaagaacagaaggacacaaaagtactggggaatacaaagaaagaatataattttgctgggttattttccacccttcattattcatatcagtatttatatatctggtccctgatggatacggctccctgggccagagaacattggttaagtggttttatcccaagacaggtgacaaaatgggagacagagtaaaaagctttttctccaccaccaacccagcgttttccactgggctagagtaggaagaagaaagatttttgcctatatcttttccaatccactcatggccactttcttctgtctccctgtccccctacagaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccagattgttcctcagaactctcagtttattcctgaatggtgtattacattaacaagtatcacatatttaagcatactggtggtctactctcctcaaattcagttggaggcatataaacatgcagaaaagcccccagccctactttcctagcatgcagcacccacatagagcaggtatatttacaaggttaccatgcaagagtgtttggcttgtcttccatcaccctgcttttcctctatcatctccttccttctatcttttatccagtgaaaatgaaaacatctccactaagaggacttcctagtatagaaatggcaagtatgtactatctaccaatttgctactagcaccaccattacctatttacatgccctttgcatttgtggccaactgatctacagcattgtgccttagtgtattcaagacacttggaattggcagttgagatgattatttgccatccccaacctagagatgatcatttactgagtaccttctatatgggaggagagttaaagtcagagggccacagccggcagtgtgactatctcagaggagatgctgagat

SEQ ID NO: 72508 - DNA, 5124 bp, Homo sapiens
aggggcccacttagatgataccagagagcaagagagaggaactggggtttgcgaaccttgtggctttgtctgtttcctgtttcagcaaggctgctgtgcaaaaagaaagacggtaccaagaagggacgtgttaatggggcccagacctatggattgaaagcgtgtgctttacccatctgctgtcttgctccatctgagaccagagccaagatctgcccaggactggaatgctttcccgagtggcttgagttggagcctgggactaggagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgactgtcctcaaggaacccttgtcttgtgccagaaggatttcttctcccagagagcaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccaggaactgcaggccaagattgaatgcctgcaaggggacagagacctgtgcagcttggatacccaggacctacaagatcaactaaaaaggtcagaggcagagaaactcaccctggtgaccagagtacagcagttgcaggaggcagcgggatggactacatgacctcctggagtcccagccagttctgggagtctgttaagtccgggatgtgtgggagctttttaaggactgatcattggctctgaggacacttcaactagttagccttctatcttgaggtatataaactgtgaaaaagggtttctattctctctgaaagcacatgtctgtgttgaacatttcaataaatttattttgaactcaggatttcatgtcaatttttacacacttgattttccaaatcacatccaactccccagccccaaaccacatagcagtccagagtcaactcactgttagccctagagagtctactgtccatgtttcctgagaattcactgtgtatacagaggggcaatagctcctcacctgtccactacacacgaccttttgttttctcttcacaatcattgggcataatataatagataaggcagaaatttttatgctcacagagtatggataagaacatgaaagtctatggtgacacaaactaacaacacagctataacaacaatccaaaacttctgactcctagtccatgctcttttcaccaagactaagactgcagggtggctaaaaaaccatctttaaccatatgaagataaattttaggatatgactgccatcttcacaactttcaaatgaggacatcagggaaaagggattgtattaaagcatttaccaaacttatttgacaaactaggaagaatgtgacatacaaccaatgaaattcaattaagaagtattcactaaaactatctagcactagataggactggggatacaaagaaaagatcccaatcttgccctcaaggagctcagattccagctgtctgtccaagcttagcaggggcctactggaagttaacctttatgtcagagaatgccatcagtctagccaaaagcacgccctcccaagttccctcccctctccccactcctagtggtttcaccctcagggcccttcctcagaggtgtgggcctcactgtcaccaagaatctggctgcttttttagatcaggctttgcccgtgtggagtccaaagtccttccctaacgaagtggagcctgagggtacagggaaggagaaagactgggatctcagagaccagctgcaaaagaagactttgcagctccaggccaaggaaaaggaggtgagagggtgacctgagatagtgagggctcatttgcgaaatagcagagaaacctgggaggcagtcaaaaagcagggatttcaaagtttaagttgtgagtggataaccacagacattcatttgcctacataaagtgtctgtgcttttgggctgacttgtcaatcttttcccttccttatttataccaactcctattcaaggttttattaaatgattaccttttagaaagtcgaccaaaactcaaacacatttaataaaaatattaacttctcaatatgtcgtcccacattgagtatcttaagtctttatatgtctcttaaagagtaaaactcttcctttgtacatactcacaaacatacacatccccagaagtattgatatgcaactagctcctgggaaagaaacttgtactaaggtcacttctaggtcgtttgttctataagaacttcatttttcggtgtctctcatttgcaaagcacttgcacgtaaagtcatataaaagaacttaaatgtataaaatgtaatactataatatgcattactgtcaatcatttaaatgaacacattccagacaatgtaagacagtcaaaagacaaactcaaatccctgagaatggctgggaagggaagatggtggtaaaaattccaaatgagtgaaacttacaaagggcagtctcccctgcctgggctctgtcctagacagaagtgacagtgatgactttggtgatgttctccccagtgcagagaactgcattcagaattagacaacctcagtgacgagtatctctcctgcctgcgtaagctgcagcactgtcgagaagagctgaaccagagccagcagctgcctcccagagtaagagggtctctccttcccataaagccctggatgatgggacgattccttctttaaccaagttttgcacataaaatatatcagcccacgccaacaactggccatcctgtcccactgtgcttggtttatactatactgacattatggcaaccattgaaaaaaacactggctcgtccatcaaagcccaactttcacagaactctcaatgccagaaggaaagacttactcttagctaaagtatgaaagggtgttcttttagccgatgataagcatggtggcaagaacagaaggacacaaaagtactggggaatacaaagaaagaatataattttgctgggttattttccacccttcattattcatatcagtatttatatatctggtccctgatggatacggctccctgggccagagaacattggttaagtggttttatcccaagacaggtgacaaaatgggagacagagtaaaaagctttttctccaccaccaacccagcgttttccactgggctagagtaggaagaagaaagatttttgcctatatcttttccaatccactcatggccactttcttctgtctccctgtccccctacagaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccagattgttcctcagaactctcagtttattcctgaatggtgtattacattaacaagtatcacatatttaagcatactggtggtctactctcctcaaattcagttggaggcatataaacatgcagaaaagcccccagccctactttcctagcatgcagcacccacatagagcaggtatatttacaaggttaccatgcaagagtgtttggcttgtcttccatcaccctgcttttcctctatcatctccttccttctatcttttatccagtgaaaatgaaaacatctccactaagaggacttcctagtatagaaatggcaagtatgtactatctaccaatttgctactagcaccaccattacctatttacatgccctttgcatttgtggccaactgatctacagcattgtgccttagtgtattcaagacacttggaattggcagttgagatgattatttgccatccccaacctagagatgatcatttactgagtaccttctatatgggaggagagttaaagtcagagggccacagccggcagtgtgactatctcagaggagatgctgagat

SEQ ID NO: 72509 - DNA, 3071 bp, Homo sapiens
agcagatgggaacatatttaataaccaaggttctaagcaaagttctgaaaagaaaactttttgtagtaaatatgctagcatagacaagttccttgtgttttccaacaggtttgcttcaaaatcaatccttacagcttcaagaacaggagaaactcttaacaaagaaaggtcagcaaatttattaccacaaattctaagatattgctcttctcttacctgcctagaggcagcgggatggactacatgacctcctggagtcccagccagttctgggagtctgttaagtccgggatgtgtgggagctttttaaggactgatcattggctctgaggacacttcaactagttagccttctatcttgaggtatataaactgtgaaaaagggtttctattctctctgaaagcacatgtctgtgttgaacatttcaataaatttattttgaactcaggatttcatgtcaatttttacacacttgattttccaaatcacatccaactccccagccccaaaccacatagcagtccagagtcaactcactgttagccctagagagtctactgtccatgtttcctgagaattcactgtgtatacagaggggcaatagctcctcacctgtccactacacacgaccttttgttttctcttcacaatcattgggcataatataatagataaggcagaaatttttatgctcacagagtatggataagaacatgaaagtctatggtgacacaaactaacaacacagctataacaacaatccaaaacttctgactcctagtccatgctcttttcaccaagactaagactgcagggtggctaaaaaaccatctttaaccatatgaagataaattttaggatatgactgccatcttcacaactttcaaatgaggacatcagggaaaagggattgtattaaagcatttaccaaacttatttgacaaactaggaagaatgtgacatacaaccaatgaaattcaattaagaagtattcactaaaactatctagcactagataggactggggatacaaagaaaagatcccaatcttgccctcaaggagctcagattccagctgtctgtccaagcttagcaggggcctactggaagttaacctttatgtcagagaatgccatcagtctagccaaaagcacgccctcccaagttccctcccctctccccactcctagtggtttcaccctcagggcccttcctcagaggtgtgggcctcactgtcaccaagaatctggctgcttttttagatcaggctttgcccgtgtggagtccaaagtccttccctaacgaagtggagcctgagggtacagggaaggagaaagactgggatctcagagaccagctgcaaaagaagactttgcagctccaggccaaggaaaaggaggtgagagggtgacctgagatagtgagggctcatttgcgaaatagcagagaaacctgggaggcagtcaaaaagcagggatttcaaagtttaagttgtgagtggataaccacagacattcatttgcctacataaagtgtctgtgcttttgggctgacttgtcaatcttttcccttccttatttataccaactcctattcaaggttttattaaatgattaccttttagaaagtcgaccaaaactcaaacacatttaataaaaatattaacttctcaatatgtcgtcccacattgagtatcttaagtctttatatgtctcttaaagagtaaaactcttcctttgtacatactcacaaacatacacatccccagaagtattgatatgcaactagctcctgggaaagaaacttgtactaaggtcacttctaggtcgtttgttctataagaacttcatttttcggtgtctctcatttgcaaagcacttgcacgtaaagtcatataaaagaacttaaatgtataaaatgtaatactataatatgcattactgtcaatcatttaaatgaacacattccagacaatgtaagacagtcaaaagacaaactcaaatccctgagaatggctgggaagggaagatggtggtaaaaattccaaatgagtgaaacttacaaagggcagtctcccctgcctgggctctgtcctagacagaagtgacagtgatgactttggtgatgttctccccagtgcagagaactgcattcagaattagacaacctcagtgacgagtatctctcctgcctgcgtaagctgcagcactgtcgagaagagctgaaccagagccagcagctgcctcccagaaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccagattgttcctcagaactctcagtttattcctgaatggtgtattacattaacaagtatcacatatttaagcatactggtggtctactctcctcaaattcagttggaggcatataaacatgcagaaaagcccccagccctactttcctagcatgcagcacccacatagagcaggtatatttacaaggttaccatgcaagagtgtttggcttgtcttccatcaccctgcttttcctctatcatctccttccttctatcttttatccagtgaaaatgaaaacatctccactaagaggacttcctagtatagaaatggcaagtatgtactatctaccaatttgctactagcaccaccattacctatttacatgccctttgcatttgtggccaactgatctacagcattgtgccttagtgtattcaagacacttggaattggcagttgagatgattatttgccatccccaacctagagatgatcatttactgagtaccttctatatgggaggagagttaaagtcagagggccacagccggcagtgtgactatctcagaggagatgctgagat

SEQ ID NO: 72510 - DNA, 3104 bp, Homo sapiens
agcagatgggaacatatttaataaccaaggttctaagcaaagttctgaaaagaaaactttttgtagtaaatatgctagcatagacaagttccttgtgttttccaacaggtttgcttcaaaatcaatccttacagcttcaagaacaggagaaactcttaacaaagaaaggtcagcaaatttattaccacaaattctaagatattgctcttctcttacctgcctagaggcagcgggatggactacatgacctcctggagtcccagccagttctgggagtctgttaagtccgggatgtgtgggagctttttaaggactgatcattggctctgaggacacttcaactagttagccttctatcttgaggtatataaactgtgaaaaagggtttctattctctctgaaagcacatgtctgtgttgaacatttcaataaatttattttgaactcaggatttcatgtcaatttttacacacttgattttccaaatcacatccaactccccagccccaaaccacatagcagtccagagtcaactcactgttagccctagagagtctactgtccatgtttcctgagaattcactgtgtatacagaggggcaatagctcctcacctgtccactacacacgaccttttgttttctcttcacaatcattgggcataatataatagataaggcagaaatttttatgctcacagagtatggataagaacatgaaagtctatggtgacacaaactaacaacacagctataacaacaatccaaaacttctgactcctagtccatgctcttttcaccaagactaagactgcagggtggctaaaaaaccatctttaaccatatgaagataaattttaggatatgactgccatcttcacaactttcaaatgaggacatcagggaaaagggattgtattaaagcatttaccaaacttatttgacaaactaggaagaatgtgacatacaaccaatgaaattcaattaagaagtattcactaaaactatctagcactagataggactggggatacaaagaaaagatcccaatcttgccctcaaggagctcagattccagctgtctgtccaagcttagcaggggcctactggaagttaacctttatgtcagagaatgccatcagtctagccaaaagcacgccctcccaagttccctcccctctccccactcctagtggtttcaccctcagggcccttcctcagaggtgtgggcctcactgtcaccaagaatctggctgcttttttagatcaggctttgcccgtgtggagtccaaagtccttccctaacgaagtggagcctgagggtacagggaaggagaaagactgggatctcagagaccagctgcaaaagaagactttgcagctccaggccaaggaaaaggaggtgagagggtgacctgagatagtgagggctcatttgcgaaatagcagagaaacctgggaggcagtcaaaaagcagggatttcaaagtttaagttgtgagtggataaccacagacattcatttgcctacataaagtgtctgtgcttttgggctgacttgtcaatcttttcccttccttatttataccaactcctattcaaggttttattaaatgattaccttttagaaagtcgaccaaaactcaaacacatttaataaaaatattaacttctcaatatgtcgtcccacattgagtatcttaagtctttatatgtctcttaaagagtaaaactcttcctttgtacatactcacaaacatacacatccccagaagtattgatatgcaactagctcctgggaaagaaacttgtactaaggtcacttctaggtcgtttgttctataagaacttcatttttcggtgtctctcatttgcaaagcacttgcacgtaaagtcatataaaagaacttaaatgtataaaatgtaatactataatatgcattactgtcaatcatttaaatgaacacattccagacaatgtaagacagtcaaaagacaaactcaaatccctgagaatggctgggaagggaagatggtggtaaaaattccaaatgagtgaaacttacaaagggcagtctcccctgcctgggctctgtcctagacagaagtgacagtgatgactttggtgatgttctccccagtgcagagaactgcattcagaattagacaacctcagtgacgagtatctctcctgcctgcgtaagctgcagcactgtcgagaagagctgaaccagagccagcagctgcctcccagagtaagagggtctctccttcccataaagccctggatgatgggacgattccttctttaaccaagttttgcacataaaatatatcagcccacgccaacaactggccatcctgtcccactgtgcttggtttatactatactgacattatggcaaccattgaaaaaaacactggctcgtccatcaaagcccaactttcacagaactctcaatgccagaaggaaagacttactcttagctaaagtatgaaagggtgttcttttagccgatgataagcatggtggcaagaacagaaggacacaaaagtactggggaatacaaagaaagaatataattttgctgggttattttccacccttcattattcatatcagtatttatatatctggtccctgatggatacggctccctgggccagagaacattggttaagtggttttatcccaagacaggtgacaaaatgggagacagagtaaaaagctttttctccaccaccaacccagcgttttccactgggctagagtaggaagaagaaagatttttgcctatatcttttccaatccactcatggccactttcttctgtctccctgtccccctacagaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccaga

SEQ ID NO: 72511 - DNA, 2020 bp, Homo sapiens
aggggcccacttagatgataccagagagcaagagagaggaactggggtttgcgaaccttgtggctttgtctgtttcctgtttcagcaaggctgctgtgcaaaaagaaagacggtaccaagaagggacgtgttaatggggcccagacctatggattgaaagcgtgtgctttacccatctgctgtcttgctccatctgagaccagagccaagatctgcccaggactggaatgctttcccgagtggcttgagttggagcctgggactaggagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgactgtcctcaaggaacccttgtcttgtgccagaaggatttcttctcccagagagcaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccaggaactgcaggccaagattgaatgcctgcaaggggacagagacctgtgcagcttggatacccaggacctacaagatcaactaaaaaggtcagaggcagagaaactcaccctggtgaccagagtacagcagttgcagggtttgcttcaaaatcaatccttacagcttcaagaacaggagaaactcttaacaaagaaaggtcagcaaatttattaccacaaattctaagatattgctcttctcttacctgcctagaggcagcgggatggactacatgacctcctggagtcccagccagttctgggagtctgttaagtccgggatgtgtgggagctttttaaggactgatcattggctctgaggacacttcaactagttagccttctatcttgaggtatataaactgtgaaaaagggtttctattctctctgaaagcacatgtctgtgttgaacatttcaataaatttattttgaactca

SEQ ID NO: 72512 - DNA, 2507 bp, Homo sapiens
agcagatgggaacatatttaataaccaaggttctaagcaaagttctgaaaagaaaactttttgtagtaaatatgctagcatagacaagttccttgtgttttccaacaggtttgcttcaaaatcaatccttacagcttcaagaacaggagaaactcttaacaaagaaaggtcagcaaatttattaccacaaattctaagatattgctcttctcttacctgcctagaggcagcgggatggactacatgacctcctggagtcccagccagttctgggagtctgttaagtccgggatgtgtgggagctttttaaggactgatcattggctctgaggacacttcaactagttagccttctatcttgaggtatataaactgtgaaaaagggtttctattctctctgaaagcacatgtctgtgttgaacatttcaataaatttattttgaactcaggatttcatgtcaatttttacacacttgattttccaaatcacatccaactccccagccccaaaccacatagcagtccagagtcaactcactgttagccctagagagtctactgtccatgtttcctgagaattcactgtgtatacagaggggcaatagctcctcacctgtccactacacacgaccttttgttttctcttcacaatcattgggcataatataatagataaggcagaaatttttatgctcacagagtatggataagaacatgaaagtctatggtgacacaaactaacaacacagctataacaacaatccaaaacttctgactcctagtccatgctcttttcaccaagactaagactgcagggtggctaaaaaaccatctttaaccatatgaagataaattttaggatatgactgccatcttcacaactttcaaatgaggacatcagggaaaagggattgtattaaagcatttaccaaacttatttgacaaactaggaagaatgtgacatacaaccaatgaaattcaattaagaagtattcactaaaactatctagcactagataggactggggatacaaagaaaagatcccaatcttgccctcaaggagctcagattccagctgtctgtccaagcttagcaggggcctactggaagttaacctttatgtcagagaatgccatcagtctagccaaaagcacgccctcccaagttccctcccctctccccactcctagtggtttcaccctcagggcccttcctcagaggtgtgggcctcactgtcaccaagaatctggctgcttttttagatcaggctttgcccgtgtggagtccaaagtccttccctaacgaagtggagcctgagggtacagggaaggagaaagactgggatctcagagaccagctgcaaaagaagactttgcagctccaggccaaggaaaaggaggtgagagggtgacctgagatagtgagggctcatttgcgaaatagcagagaaacctgggaggcagtcaaaaagcagggatttcaaagtttaagttgtgagtggataaccacagacattcatttgcctacataaagtgtctgtgcttttgggctgacttgtcaatcttttcccttccttatttataccaactcctattcaaggttttattaaatgattaccttttagaaagtcgaccaaaactcaaacacatttaataaaaatattaacttctcaatatgtcgtcccacattgagtatcttaagtctttatatgtctcttaaagagtaaaactcttcctttgtacatactcacaaacatacacatccccagaagtattgatatgcaactagctcctgggaaagaaacttgtactaaggtcacttctaggtcgtttgttctataagaacttcatttttcggtgtctctcatttgcaaagcacttgcacgtaaagtcatataaaagaacttaaatgtataaaatgtaatactataatatgcattactgtcaatcatttaaatgaacacattccagacaatgtaagacagtcaaaagacaaactcaaatccctgagaatggctgggaagggaagatggtggtaaaaattccaaatgagtgaaacttacaaagggcagtctcccctgcctgggctctgtcctagacagaagtgacagtgatgactttggtgatgttctccccagtgcagagaactgcattcagaattagacaacctcagtgacgagtatctctcctgcctgcgtaagctgcagcactgtcgagaagagctgaaccagagccagcagctgcctcccagaaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccaga

SEQ ID NO: 72513 - DNA, 2673 bp, Homo sapiens
aggggcccacttagatgataccagagagcaagagagaggaactggggtttgcgaaccttgtggctttgtctgtttcctgtttcagcaaggctgctgtgcaaaaagaaagacggtaccaagaagggacgtgttaatggggcccagacctatggattgaaagcgtgtgctttacccatctgctgtcttgctccatctgagaccagagccaagatctgcccaggactggaatgctttcccgagtggcttgagttggagcctgggactaggagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgactgtcctcaaggaacccttgtcttgtgccagaaggatttcttctcccagagagcaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccaggaactgcaggccaagattgaatgcctgcaaggggacagagacctgtgcagcttggatacccaggacctacaagatcaactaaaaaggtcagaggcagagaaactcaccctggtgaccagagtacagcagttgcagggtttgcttcaaaatcaatccttacagcttcaagaacaggagaaactcttaacaaagaaagtgcagagaactgcattcagaattagacaacctcagtgacgagtatctctcctgcctgcgtaagctgcagcactgtcgagaagagctgaaccagagccagcagctgcctcccagaaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccagattgttcctcagaactctcagtttattcctgaatggtgtattacattaacaagtatcacatatttaagcatactggtggtctactctcctcaaattcagttggaggcatataaacatgcagaaaagcccccagccctactttcctagcatgcagcacccacatagagcaggtatatttacaaggttaccatgcaagagtgtttggcttgtcttccatcaccctgcttttcctctatcatctccttccttctatcttttatccagtgaaaatgaaaacatctccactaagaggacttcctagtatagaaatggcaagtatgtactatctaccaatttgctactagcaccaccattacctatttacatgccctttgcatttgtggccaactgatctacagcattgtgccttagtgtattcaagacacttggaattggcagttgagatgattatttgccatccccaacctagagatgatcatttactgagtaccttctatatgggaggagagttaaagtcagagggccacagccggcagtgtgactatctcagaggagatgctgagat

SEQ ID NO: 72514 - DNA, 4233 bp, Homo sapiens
gagcagagagatgagctgtgggctggtgcttctgtggtgaggtggtggtgtttctggagagcagatcagaggcaggggaaaaccacgcagaagcaggagctgaagacctcagaccggcaccagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccaggaactgcaggccaagattgaatgcctgcaaggggacagagacctgtgcagcttggatacccaggacctacaagatcaactaaaaaggtcagaggcagagaaactcaccctggtgaccagagtacagcagttgcagggtttgcttcaaaatcaatccttacagcttcaagaacaggagaaactcttaacaaagaaaggtcagcaaatttattaccacaaattctaagatattgctcttctcttacctgcctagaggcagcgggatggactacatgacctcctggagtcccagccagttctgggagtctgttaagtccgggatgtgtgggagctttttaaggactgatcattggctctgaggacacttcaactagttagccttctatcttgaggtatataaactgtgaaaaagggtttctattctctctgaaagcacatgtctgtgttgaacatttcaataaatttattttgaactcaggatttcatgtcaatttttacacacttgattttccaaatcacatccaactccccagccccaaaccacatagcagtccagagtcaactcactgttagccctagagagtctactgtccatgtttcctgagaattcactgtgtatacagaggggcaatagctcctcacctgtccactacacacgaccttttgttttctcttcacaatcattgggcataatataatagataaggcagaaatttttatgctcacagagtatggataagaacatgaaagtctatggtgacacaaactaacaacacagctataacaacaatccaaaacttctgactcctagtccatgctcttttcaccaagactaagactgcagggtggctaaaaaaccatctttaaccatatgaagataaattttaggatatgactgccatcttcacaactttcaaatgaggacatcagggaaaagggattgtattaaagcatttaccaaacttatttgacaaactaggaagaatgtgacatacaaccaatgaaattcaattaagaagtattcactaaaactatctagcactagataggactggggatacaaagaaaagatcccaatcttgccctcaaggagctcagattccagctgtctgtccaagcttagcaggggcctactggaagttaacctttatgtcagagaatgccatcagtctagccaaaagcacgccctcccaagttccctcccctctccccactcctagtggtttcaccctcagggcccttcctcagaggtgtgggcctcactgtcaccaagaatctggctgcttttttagatcaggctttgcccgtgtggagtccaaagtccttccctaacgaagtggagcctgagggtacagggaaggagaaagactgggatctcagagaccagctgcaaaagaagactttgcagctccaggccaaggaaaaggaggtgagagggtgacctgagatagtgagggctcatttgcgaaatagcagagaaacctgggaggcagtcaaaaagcagggatttcaaagtttaagttgtgagtggataaccacagacattcatttgcctacataaagtgtctgtgcttttgggctgacttgtcaatcttttcccttccttatttataccaactcctattcaaggttttattaaatgattaccttttagaaagtcgaccaaaactcaaacacatttaataaaaatattaacttctcaatatgtcgtcccacattgagtatcttaagtctttatatgtctcttaaagagtaaaactcttcctttgtacatactcacaaacatacacatccccagaagtattgatatgcaactagctcctgggaaagaaacttgtactaaggtcacttctaggtcgtttgttctataagaacttcatttttcggtgtctctcatttgcaaagcacttgcacgtaaagtcatataaaagaacttaaatgtataaaatgtaatactataatatgcattactgtcaatcatttaaatgaacacattccagacaatgtaagacagtcaaaagacaaactcaaatccctgagaatggctgggaagggaagatggtggtaaaaattccaaatgagtgaaacttacaaagggcagtctcccctgcctgggctctgtcctagacagaagtgacagtgatgactttggtgatgttctccccagtgcagagaactgcattcagaattagacaacctcagtgacgagtatctctcctgcctgcgtaagctgcagcactgtcgagaagagctgaaccagagccagcagctgcctcccagagtaagagggtctctccttcccataaagccctggatgatgggacgattccttctttaaccaagttttgcacataaaatatatcagcccacgccaacaactggccatcctgtcccactgtgcttggtttatactatactgacattatggcaaccattgaaaaaaacactggctcgtccatcaaagcccaactttcacagaactctcaatgccagaaggaaagacttactcttagctaaagtatgaaagggtgttcttttagccgatgataagcatggtggcaagaacagaaggacacaaaagtactggggaatacaaagaaagaatataattttgctgggttattttccacccttcattattcatatcagtatttatatatctggtccctgatggatacggctccctgggccagagaacattggttaagtggttttatcccaagacaggtgacaaaatgggagacagagtaaaaagctttttctccaccaccaacccagcgttttccactgggctagagtaggaagaagaaagatttttgcctatatcttttccaatccactcatggccactttcttctgtctccctgtccccctacagaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccagattgttcctcagaactctcagtttattcctgaatggtgtattacattaacaagtatcacatatttaagcatactggtggtctactctcctcaaattcagttggaggcatataaacatgcagaaaagcccccagccctactttcctagcatgcagcacccacatagagcaggtatatttacaaggttaccatgcaagagtgtttggcttgtcttccatcaccctgcttttcctctatcatctccttccttctatcttttatccagtgaaaatgaaaacatctccactaagaggacttcctagtatagaaatggcaagtatgtactatctaccaatttgctactagcaccaccattacctatttacatgccctttgcatttgtggccaactgatctacagcattgtgccttagtgtattcaagacacttggaattggcagttgagatgattatttgccatccccaacctagagatgatcatttactgagtaccttctatatgggaggagagttaaagtcagagggccacagccggcagtgtgactatctcagaggagatgctgagat

SEQ ID NO: 72515 - DNA, 3225 bp, Homo sapiens
aggggcccacttagatgataccagagagcaagagagaggaactggggtttgcgaaccttgtggctttgtctgtttcctgtttcagcaaggctgctgtgcaaaaagaaagacggtaccaagaagggacgtgttaatggggcccagacctatggattgaaagcgtgtgctttacccatctgctgtcttgctccatctgagaccagagccaagatctgcccaggactggaatgctttcccgagtggcttgagttggagcctgggactaggagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgactgtcctcaaggaacccttgtcttgtgccagaaggatttcttctcccagagagcaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccaggaactgcaggccaagattgaatgcctgcaaggggacagagacctgtgcagcttggatacccaggacctacaagatcaactaaaaaggtcagaggcagagaaactcaccctggtgaccagagtacagcagttgcaggaggcagcgggatggactacatgacctcctggagtcccagccagttctgggagtctgttaagtccgggatgtgtgggagctttttaaggactgatcattggctctgaggacacttcaactagttagccttctatcttgaggtatataaactgtgaaaaagggtttctattctctctgaaagcacatgtctgtgttgaacatttcaataaatttattttgaactcaggatttcatgtcaatttttacacacttgattttccaaatcacatccaactccccagccccaaaccacatagcagtccagagtcaactcactgttagccctagagagtctactgtccatgtttcctgagaattcactgtgtatacagaggggcaatagctcctcacctgtccactacacacgaccttttgttttctcttcacaatcattgggcataatataatagataaggcagaaatttttatgctcacagagtatggataagaacatgaaagtctatggtgacacaaactaacaacacagctataacaacaatccaaaacttctgactcctagtccatgctcttttcaccaagactaagactgcagggtggctaaaaaaccatctttaaccatatgaagataaattttaggatatgactgccatcttcacaactttcaaatgaggacatcagggaaaagggattgtattaaagcatttaccaaacttatttgacaaactaggaagaatgtgacatacaaccaatgaaattcaattaagaagtattcactaaaactatctagcactagataggactggggatacaaagaaaagatcccaatcttgccctcaaggagctcagattccagctgtctgtccaagcttagcaggggcctactggaagttaacctttatgtcagagaatgccatcagtctagccaaaagcacgccctcccaagttccctcccctctccccactcctagtggtttcaccctcagggcccttcctcagaggtgtgggcctcactgtcaccaagaatctggctgcttttttagatcaggctttgcccgtgtggagtccaaagtccttccctaacgaagtggagcctgagggtacagggaaggagaaagactgggatctcagagaccagctgcaaaagaagactttgcagctccaggccaaggaaaaggagtgcagagaactgcattcagaattagacaacctcagtgacgagtatctctcctgcctgcgtaagctgcagcactgtcgagaagagctgaaccagagccagcagctgcctcccagaaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccaga

SEQ ID NO: 72516 - DNA, 2186 bp, Homo sapiens
aggggcccacttagatgataccagagagcaagagagaggaactggggtttgcgaaccttgtggctttgtctgtttcctgtttcagcaaggctgctgtgcaaaaagaaagacggtaccaagaagggacgtgttaatggggcccagacctatggattgaaagcgtgtgctttacccatctgctgtcttgctccatctgagaccagagccaagatctgcccaggactggaatgctttcccgagtggcttgagttggagcctgggactaggagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgactgtcctcaaggaacccttgtcttgtgccagaaggatttcttctcccagagagcaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccaggaactgcaggccaagattgaatgcctgcaaggggacagagacctgtgcagcttggatacccaggacctacaagatcaactaaaaaggtcagaggcagagaaactcaccctggtgaccagagtacagcagttgcaggatcaggctttgcccgtgtggagtccaaagtccttccctaacgaagtggagcctgagggtacagggaaggagaaagactgggatctcagagaccagctgcaaaagaagactttgcagctccaggccaaggaaaaggagtgcagagaactgcattcagaattagacaacctcagtgacgagtatctctcctgcctgcgtaagctgcagcactgtcgagaagagctgaaccagagccagcagctgcctcccagaaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccaga

SEQ ID NO: 72517 - DNA, 2339 bp, Homo sapiens
aggggcccacttagatgataccagagagcaagagagaggaactggggtttgcgaaccttgtggctttgtctgtttcctgtttcagcaaggctgctgtgcaaaaagaaagacggtaccaagaagggacgtgttaatggggcccagacctatggattgaaagcgtgtgctttacccatctgctgtcttgctccatctgagaccagagccaagatctgcccaggactggaatgctttcccgagtggcttgagttggagcctgggactaggagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgactgtcctcaaggaacccttgtcttgtgccagaaggatttcttctcccagagagcaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccaggaactgcaggccaagattgaatgcctgcaaggggacagagacctgtgcagcttggatacccaggacctacaagatcaactaaaaaggtcagaggcagagaaactcaccctggtgaccagagtacagcagttgcaggaggcagcgggatggactacatgacctcctggagtcccagccagttctgggagtctgttaagtccgggatgtgtgggagctttttaaggactgatcattggctctgaggacacttcaactagttagccttctatcttgaggtatataaactgtgaaaaagggtttctattctctctgaaagcacatgtctgtgttgaacatttcaataaatttattttgaactcaaaaaaaaaaaaaaaaaaataacaacaagaaataaaatgaaaaaaaataaaaaaaaaatgacaagatgaagcctcaatattgctaagttcaaagcaatgctaacattccagttttttaagaaggttattaatggcctttggacattttggactctattatgaaaaattagaatcccctttcactgatttctccatatcattttttttaaaatccttatctatcctcgggctttacaaaaatttataatttctctatttcccaaagggtgacatttcaaaacctcaccccttttcaatattctgtcgattaaaacaatttaggtacccctttttaacaagtcgttcaaacaatactcttgtcttccttgggctaatctttaagatctccctttgctcttcttttcgagataatgttcatcctctctttgtccgtcct

SEQ ID NO: 72518 - DNA, 1957 bp, Homo sapiens
aggggcccacttagatgataccagagagcaagagagaggaactggggtttgcgaaccttgtggctttgtctgtttcctgtttcagcaaggctgctgtgcaaaaagaaagacggtaccaagaagggacgtgttaatggggcccagacctatggattgaaagcgtgtgctttacccatctgctgtcttgctccatctgagaccagagccaagatctgcccaggactggaatgctttcccgagtggcttgagttggagcctgggactaggagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgactgtcctcaaggaacccttgtcttgtgccagaaggatttcttctcccagagagcaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccaggaactgcaggccaagattgaatgcctgcaaggggacagagacctgtgcagcttggatacccaggacctacaaggtttgcttcaaaatcaatccttacagcttcaagaacaggagaaactcttaacaaagaaaggtcagcaaatttattaccacaaattctaagatattgctcttctcttacctgcctagaggcagcgggatggactacatgacctcctggagtcccagccagttctgggagtctgttaagtccgggatgtgtgggagctttttaaggactgatcattggctctgaggacacttcaactagttagccttctatcttgaggtatataaactgtgaaaaagggtttctattctctctgaaagcacatgtctgtgttgaacatttcaataaatttattttgaactca

SEQ ID NO: 72519 - DNA, 353 bp, Homo sapiens
tccagagagctcgactgcagcagttcttcaggaggaggaacctggagctagaggagaagggcaaagcgcagcatccccaggccagggagcaagggccctccaggcggccaggacaggtgactgtcctcaaggaacccttgtcttgtgccagaaggatttcttctcccagagagcaggtgggccgtgtcaagggacatactgctgtgtgctctgggaccctctctggacaaggagggtgggtgggctcaaggtcactaaaaagtgacctaaatcaagtccttcttcctcagtcatatagtaaagttgccaagagctacttatagtaaagttgccaacagctacttattcagaga

SEQ ID NO: 72520 - DNA, 418 bp, Homo sapiens
ttgcatcaaatttacagaaatactccccttggggaatgaaaaaagtactactggagatggaagaccagaattagacaacctcagtgacgagtatctctcctgcctgcgtaagctgcagcactgtcgagaagagctgaaccagagccagcagctgcctcccagaaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccaga

SEQ ID NO: 72521 - DNA, 5240 bp, Homo sapiens
aggggcccacttagatgataccagagagcaagagagaggaactggggtttgcgaaccttgtggctttgtctgtttcctgtttcagcaaggctgctgtgcaaaaagaaagacggtaccaagaagggacgtgttaatggggcccagacctatggattgaaagcgtgtgctttacccatctgctgtcttgctccatctgagaccagagccaagatctgcccaggactggaatgctttcccgagtggcttgagttggagcctgggactaggagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgactgtcctcaaggaacccttgtcttgtgccagaaggatttcttctcccagagagcaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccaggaactgcaggccaagattgaatgcctgcaaggggacagagacctgtgcagcttggatacccaggacctacaagatcaactaaaaaggtcagaggcagagaaactcaccctggtgaccagagtacagcagttgcagggtttgcttcaaaatcaatccttacagcttcaagaacaggagaaactcttaacaaagaaaggtcagcaaatttattaccacaaattctaagatattgctcttctcttacctgcctagaggcagcgggatggactacatgacctcctggagtcccagccagttctgggagtctgttaagtccgggatgtgtgggagctttttaaggactgatcattggctctgaggacacttcaactagttagccttctatcttgaggtatataaactgtgaaaaagggtttctattctctctgaaagcacatgtctgtgttgaacatttcaataaatttattttgaactcaggatttcatgtcaatttttacacacttgattttccaaatcacatccaactccccagccccaaaccacatagcagtccagagtcaactcactgttagccctagagagtctactgtccatgtttcctgagaattcactgtgtatacagaggggcaatagctcctcacctgtccactacacacgaccttttgttttctcttcacaatcattgggcataatataatagataaggcagaaatttttatgctcacagagtatggataagaacatgaaagtctatggtgacacaaactaacaacacagctataacaacaatccaaaacttctgactcctagtccatgctcttttcaccaagactaagactgcagggtggctaaaaaaccatctttaaccatatgaagataaattttaggatatgactgccatcttcacaactttcaaatgaggacatcagggaaaagggattgtattaaagcatttaccaaacttatttgacaaactaggaagaatgtgacatacaaccaatgaaattcaattaagaagtattcactaaaactatctagcactagataggactggggatacaaagaaaagatcccaatcttgccctcaaggagctcagattccagctgtctgtccaagcttagcaggggcctactggaagttaacctttatgtcagagaatgccatcagtctagccaaaagcacgccctcccaagttccctcccctctccccactcctagtggtttcaccctcagggcccttcctcagaggtgtgggcctcactgtcaccaagaatctggctgcttttttagatcaggctttgcccgtgtggagtccaaagtccttccctaacgaagtggagcctgagggtacagggaaggagaaagactgggatctcagagaccagctgcaaaagaagactttgcagctccaggccaaggaaaaggaggtgagagggtgacctgagatagtgagggctcatttgcgaaatagcagagaaacctgggaggcagtcaaaaagcagggatttcaaagtttaagttgtgagtggataaccacagacattcatttgcctacataaagtgtctgtgcttttgggctgacttgtcaatcttttcccttccttatttataccaactcctattcaaggttttattaaatgattaccttttagaaagtcgaccaaaactcaaacacatttaataaaaatattaacttctcaatatgtcgtcccacattgagtatcttaagtctttatatgtctcttaaagagtaaaactcttcctttgtacatactcacaaacatacacatccccagaagtattgatatgcaactagctcctgggaaagaaacttgtactaaggtcacttctaggtcgtttgttctataagaacttcatttttcggtgtctctcatttgcaaagcacttgcacgtaaagtcatataaaagaacttaaatgtataaaatgtaatactataatatgcattactgtcaatcatttaaatgaacacattccagacaatgtaagacagtcaaaagacaaactcaaatccctgagaatggctgggaagggaagatggtggtaaaaattccaaatgagtgaaacttacaaagggcagtctcccctgcctgggctctgtcctagacagaagtgacagtgatgactttggtgatgttctccccagtgcagagaactgcattcagaattagacaacctcagtgacgagtatctctcctgcctgcgtaagctgcagcactgtcgagaagagctgaaccagagccagcagctgcctcccagagtaagagggtctctccttcccataaagccctggatgatgggacgattccttctttaaccaagttttgcacataaaatatatcagcccacgccaacaactggccatcctgtcccactgtgcttggtttatactatactgacattatggcaaccattgaaaaaaacactggctcgtccatcaaagcccaactttcacagaactctcaatgccagaaggaaagacttactcttagctaaagtatgaaagggtgttcttttagccgatgataagcatggtggcaagaacagaaggacacaaaagtactggggaatacaaagaaagaatataattttgctgggttattttccacccttcattattcatatcagtatttatatatctggtccctgatggatacggctccctgggccagagaacattggttaagtggttttatcccaagacaggtgacaaaatgggagacagagtaaaaagctttttctccaccaccaacccagcgttttccactgggctagagtaggaagaagaaagatttttgcctatatcttttccaatccactcatggccactttcttctgtctccctgtccccctacagaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccagattgttcctcagaactctcagtttattcctgaatggtgtattacattaacaagtatcacatatttaagcatactggtggtctactctcctcaaattcagttggaggcatataaacatgcagaaaagcccccagccctactttcctagcatgcagcacccacatagagcaggtatatttacaaggttaccatgcaagagtgtttggcttgtcttccatcaccctgcttttcctctatcatctccttccttctatcttttatccagtgaaaatgaaaacatctccactaagaggacttcctagtatagaaatggcaagtatgtactatctaccaatttgctactagcaccaccattacctatttacatgccctttgcatttgtggccaactgatctacagcattgtgccttagtgtattcaagacacttggaattggcagttgagatgattatttgccatccccaacctagagatgatcatttactgagtaccttctatatgggaggagagttaaagtcagagggccacagccggcagtgtgactatctcagaggagatgctgagat

SEQ ID NO: 72522 - DNA, 4077 bp, Homo sapiens
ctggattagggactccaaaggcagctgacagcatctggctttcagttcctcagtcaccactactttgtaccaaattcactgttttggctctgaaatctaattttgagtttagcaaggatgtctgcattgctcatgcaaatgaactaagcgttcattggaatgacaccatcaccacccaaatgaaaagaactggctggaatattcatcagcctactaatgtcatctcccaacccactctccaaactccatcccaaaaaagcatccagttcagaattgcccactgttggcaaagaaagaatgtcactaatttatttacagggagcagatagcagggacttacagatgaaccaggccctgcgatttttggaaaatgagcaccaggaactgcaggccaagattgaatgcctgcaaggggacagagacctgtgcagcttggatacccaggacctacaagatcaactaaaaaggtcagaggcagagaaactcaccctggtgaccagagtacagcagttgcagggtttgcttcaaaatcaatccttacagcttcaagaacaggagaaactcttaacaaagaaaggtcagcaaatttattaccacaaattctaagatattgctcttctcttacctgcctagaggcagcgggatggactacatgacctcctggagtcccagccagttctgggagtctgttaagtccgggatgtgtgggagctttttaaggactgatcattggctctgaggacacttcaactagttagccttctatcttgaggtatataaactgtgaaaaagggtttctattctctctgaaagcacatgtctgtgttgaacatttcaataaatttattttgaactcaggatttcatgtcaatttttacacacttgattttccaaatcacatccaactccccagccccaaaccacatagcagtccagagtcaactcactgttagccctagagagtctactgtccatgtttcctgagaattcactgtgtatacagaggggcaatagctcctcacctgtccactacacacgaccttttgttttctcttcacaatcattgggcataatataatagataaggcagaaatttttatgctcacagagtatggataagaacatgaaagtctatggtgacacaaactaacaacacagctataacaacaatccaaaacttctgactcctagtccatgctcttttcaccaagactaagactgcagggtggctaaaaaaccatctttaaccatatgaagataaattttaggatatgactgccatcttcacaactttcaaatgaggacatcagggaaaagggattgtattaaagcatttaccaaacttatttgacaaactaggaagaatgtgacatacaaccaatgaaattcaattaagaagtattcactaaaactatctagcactagataggactggggatacaaagaaaagatcccaatcttgccctcaaggagctcagattccagctgtctgtccaagcttagcaggggcctactggaagttaacctttatgtcagagaatgccatcagtctagccaaaagcacgccctcccaagttccctcccctctccccactcctagtggtttcaccctcagggcccttcctcagaggtgtgggcctcactgtcaccaagaatctggctgcttttttagatcaggctttgcccgtgtggagtccaaagtccttccctaacgaagtggagcctgagggtacagggaaggagaaagactgggatctcagagaccagctgcaaaagaagactttgcagctccaggccaaggaaaaggaggtgagagggtgacctgagatagtgagggctcatttgcgaaatagcagagaaacctgggaggcagtcaaaaagcagggatttcaaagtttaagttgtgagtggataaccacagacattcatttgcctacataaagtgtctgtgcttttgggctgacttgtcaatcttttcccttccttatttataccaactcctattcaaggttttattaaatgattaccttttagaaagtcgaccaaaactcaaacacatttaataaaaatattaacttctcaatatgtcgtcccacattgagtatcttaagtctttatatgtctcttaaagagtaaaactcttcctttgtacatactcacaaacatacacatccccagaagtattgatatgcaactagctcctgggaaagaaacttgtactaaggtcacttctaggtcgtttgttctataagaacttcatttttcggtgtctctcatttgcaaagcacttgcacgtaaagtcatataaaagaacttaaatgtataaaatgtaatactataatatgcattactgtcaatcatttaaatgaacacattccagacaatgtaagacagtcaaaagacaaactcaaatccctgagaatggctgggaagggaagatggtggtaaaaattccaaatgagtgaaacttacaaagggcagtctcccctgcctgggctctgtcctagacagaagtgacagtgatgactttggtgatgttctccccagtgcagagaactgcattcagaattagacaacctcagtgacgagtatctctcctgcctgcgtaagctgcagcactgtcgagaagagctgaaccagagccagcagctgcctcccagagtaagagggtctctccttcccataaagccctggatgatgggacgattccttctttaaccaagttttgcacataaaatatatcagcccacgccaacaactggccatcctgtcccactgtgcttggtttatactatactgacattatggcaaccattgaaaaaaacactggctcgtccatcaaagcccaactttcacagaactctcaatgccagaaggaaagacttactcttagctaaagtatgaaagggtgttcttttagccgatgataagcatggtggcaagaacagaaggacacaaaagtactggggaatacaaagaaagaatataattttgctgggttattttccacccttcattattcatatcagtatttatatatctggtccctgatggatacggctccctgggccagagaacattggttaagtggttttatcccaagacaggtgacaaaatgggagacagagtaaaaagctttttctccaccaccaacccagcgttttccactgggctagagtaggaagaagaaagatttttgcctatatcttttccaatccactcatggccactttcttctgtctccctgtccccctacagaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccagattgttcctcagaactctcagtttattcctgaatggtgtattacattaacaagtatcacatatttaagcatactggtggtctactctcctcaaattcagttggaggcatataaacatgcagaaaagcccccagccctactttcctagcatgcagcacccacatagagcaggtatatttacaaggttaccatgcaagagtgtttggcttgtcttccatcaccctgcttttcctctatcatctccttccttctatcttttatccagtgaaaatgaaaacatctccactaagaggacttcctagtatagaaatggcaagtatgtactatctaccaatttgctactagcaccaccattacctatttacatgccctttgcatttgtggccaactgatctacagcattgtgccttagtgtattcaagacacttggaattggcagttgagatgattatttgccatccccaacctagagatgatcatttactgagtaccttctatatgggaggagagttaaagtcagagggccacagccggcagtgtgactatctcagaggagatgctgagat

SEQ ID NO: 72523 - DNA, 2246 bp, Homo sapiens
aggggcccacttagatgataccagagagcaagagagaggaactggggtttgcgaaccttgtggctttgtctgtttcctgtttcagcaaggctgctgtgcaaaaagaaagacggtaccaagaagggacgtgttaatggggcccagacctatggattgaaagcgtgtgctttacccatctgctgtcttgctccatctgagaccagagccaagatctgcccaggactggaatgctttcccgagtggcttgagttggagcctgggactaggagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgactgtcctcaaggaacccttgtcttgtgccagaaggatttcttctcccagagagcaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccaggaactgcaggccaagattgaatgcctgcaaggggacagagacctgtgcagcttggatacccaggacctacaagatcaactaaaaaggtcagaggcagagaaactcaccctggtgaccagagtacagcagttgcagggtttgcttcaaaatcaatccttacagcttcaagaacaggagaaactcttaacaaagaaagatcaggctttgcccgtgtggagtccaaagtccttccctaacgaagtggagcctgagggtacagggaaggagaaagactgggatctcagagaccagctgcaaaagaagactttgcagctccaggccaaggaaaaggagtgcagagaactgcattcagaattagacaacctcagtgacgagtatctctcctgcctgcgtaagctgcagcactgtcgagaagagctgaaccagagccagcagctgcctcccagaaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccaga

SEQ ID NO: 72524 - DNA, 2109 bp, Homo sapiens
aggggcccacttagatgataccagagagcaagagagaggaactggggtttgcgaaccttgtggctttgtctgtttcctgtttcagcaaggctgctgtgcaaaaagaaagacggtaccaagaagggacgtgttaatggggcccagacctatggattgaaagcgtgtgctttacccatctgctgtcttgctccatctgagaccagagccaagatctgcccaggactggaatgctttcccgagtggcttgagttggagcctgggactaggagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgactgtcctcaaggaacccttgtcttgtgccagaaggatttcttctcccagagagcaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccaggaactgcaggccaagattgaatgcctgcaaggggacagagacctgtgcagcttggatacccaggacctacaagatcaactaaaaaggtcagaggcagagaaactcaccctggtgaccagagtacagcagttgcagggtttgcttcaaaatcaatccttacagcttcaagaacaggagaaactcttaacaaagaaagtgcagagaactgcattcagaattagacaacctcagtgacgagtatctctcctgcctgcgtaagctgcagcactgtcgagaagagctgaaccagagccagcagctgcctcccagaaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccaga

SEQ ID NO: 72525 - DNA, 2457 bp, Homo sapiens
aggaatgttggtgctcccagcacctagcaccgggagactggagaggtttccaggagagtgacccgagtaggtcccctcctaattctggagccgtccctcgggctgcgcagtggagcgccgaggtggcgggaggctgcggggagcctgcgcggccaagcaccatctgcagtcaggagctcccgggcagcttgcagggcgcagtttttgaaagcgggtgctgcgtgcggaccgcgggcctgcagggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacaggtgggtgcgcccttcccccggctgcacttcccagtggggatctctgctgtcgcccaagcctgacagctggatccaggggagtgggtgtagacctcactgccctccagcagcttctgcatgtgcactattcggctactgggatcattcctgaggaatgttctgagcctaccaagcctttccagatcattctacatcacgatcacacagagtgggtgcagagtattgggatgcccatctgggcaccatctcatcatcagagtcggccatagggaaaacgaggactccaaccagcatgtgccgaactctgtggccaagacagtctgacaataagttattgcccacagaggatgtctaagtctttgtgtccactctgtgatcgtgatctagaattttctaccaaggcttgatggggaactaggatattcttctgcaatgattcagaattttacagtgtacctttatactttaataagtgaattctatatatggtagtttggtaggattctgtgtagaagtgctttaggaggtgattgaaagctgtagggacttaccatacggttatgtattgcttggtgatggggtataaaattgtcatgtgaacatcttggagtgcacttacttagctgatacagcccacgacacacatatgctttgtggtatagcctgttgcttcgaggctacaaacctgtacagtgtgtgactctactgagtactgtaggcacctgtatgtaacacaatggtaaggatttgtgtatctaaacatatctcaacatagaaaaggcacagtagaaatgtggtcatatgggaccgccctcgtacatgcaggccttcactgactgaatgtcgtaatgtggcgcatgactgtgtttaaagatttgtccaaatgcagtttaccaggataagcctggaatccgatttcaattgctgtcttttaaagcaggtgtggcaaacgggtggtgatgtgtgtgccagctccactcggtggtggccccagcgctcccatgctccgaaggagtcaggaactggaaagggtacctgcctggagcagtttgtgtgtgtgctaaggggtggggaaggcggggactgggaaccatgtatttgcagtccatgttgacacatttgttgcataaagtcatagaaaacactttcctttaagagtgtcttaatttttaccatgaaatatgatacctgaaaagaacaagaaagcaaagtggaccttcattatacagctaacttttttaaatttaaattttagtgtgcttctaaaattggggataaaaccatccatcaattactaccaagtaagtcttgcttttgcttcttttctcgtgtgtctctcccggggacctccagtagggccgtttcagcctctgagtcaatgggctgtaaattgccccagtgcaaacccccttcctacttaaatgttatcatgtgaacagattttatttgcattttattttcctgcgcatgttgagtaggagctgaaggctgcttagaccagtgatttggaagcacagatttcatggctccctttgtgagaagtgtgtgctccagggtccggcagagcaggtggaatctgcagtttgaagagtcacattcacttttataacgtagtcttatatttgtttgtggtttgttttcatgataaaattgtgatttgttttatgataaaagaaactatagatatttaagcatgacaagatgttattagctggtaagcatatacaaaaagttgctttttgccaggtgtggtgactcacgcctataaatcccaggaccttgggaggctcaggctggaggattgcttgtggctagaatttcgagaccagcctgggcagcagagtgagacctctagaaagaagtaaaagtagctgagcatgatagtatgtgtctgtggtctcagctattcaggaagctaaggtcagaggattgcctgcgcccaggaatttgaggctgcagtgagccatggtcgccccactgcactccagtctgggcgacagccagatcacgtctctttaaaaaaaaaaga

SEQ ID NO: 72526 - DNA, 384 bp, Homo sapiens
agtattcttgttttccgtttcgcatgtttttgcgtgctcatcccccctcctcttcggttagaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcagctttctaatatacatcacggagcacagagaagttagtccgtttggcctcgttggccttaa

SEQ ID NO: 72527 - DNA, 598 bp, Homo sapiens
tgattcctgataaaggatagtgcattaataagtcgtttccttagaaagacggaaactctggaagtctgtaggtctttgccgcagaactcctggaacaagcaggcaggaaagagatgtgggccagggttctttaagccccagaaatgaccccaacctgcctaaatcgtccctgcctgccctcaccctctattcttgagaagtggaatacgttgtcccacttgagccagttgacttgtaaagcaaagtgccttctgagcgccacaccgagcccactcactgtccgaatctggttgctagagagcccagggtgtgcccttacctctccgtcgggacgtttcagggtgtcagcgtcttagctgctctcactgaccttcatcataagaggtcataataaaccagtgaagtcgtgaaaaacatgacaggcaattgcacagcctctgtgttgctgcttttggaattcacgcagcttgttttagagcaattctccttcaaatcagaataataccaggagccttagctaatcagctgtatttaaggtttctgaatcaaaactgcttaaaagatgaataaacctccattgcttatctagacatgtgct

SEQ ID NO: 72528 - DNA, 1977 bp, Homo sapiens
aggaatgttggtgctcccagcacctagcaccgggagactggagaggtttccaggagagtgacccgagtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcagctttctaaaaaacaactccaaagtgaagtctgtttattttgctgtttcccctccatgcctgtgaattggatgttgtggtccctgtagagtgagtgcatgtggcgtacacggggagaaaggagctctcccacgcctgagtggctgttttgtgcttgggataaagctcacagattgtttttttttttctctattaaactcttcagtgccctggtagatcaggcaggcatacttggaatttagacagatggcaccgattcaggggactctcttgctcgagttttcccctcggagcctgttgccttcttggcgcagggaccctgtcaagacgaagagctccacgcatggcaggagcccacgctgatgcctggtgggcctggggggtgtctctagctcagactgggtctgttccatgtgaccagagccccaggacatcgttccttagccagctgctccgttgttggaggcctggtgtggtcacaggtgtgtcctagaacggtgactttgcccctcctgccctaggagatttgggtgtattcacagagcagccatctcctgtctccgtcagagcagtctcttccaggttactggaaggtcagtttctgtcaggcctcacttccttcttatcagagggtagccaggtccctgcactggtatctatttagaaatgtacatggagcccccagcgaaatgtgcctacattgtgtgttccagaaccggaggtacccttaccttctagatatgtgatgacatggctctcacgtcaggcagactgctgcacccacgctctcggcctgccgtgcagggatttcactcgtggagtgaggcatctgggggctgtgcagtgaggagctttccatgtgttgttaagacaacctgttagcattgtcttctcccgcgtctcctggcctcttctctctttaaatccttttctctgtttgtcttaatcacattaacgtcctatttatgttttattcaatatacatttaaaatagaacttactatgtgccaggcattgtgttcaacacgtgaaatatttaatccttagaataaccatattgtcagcataatttacaa

SEQ ID NO: 72529 - DNA, 2369 bp, Homo sapiens
ctcctgcctcggcctctctgagccaaccacggggcggggcgtgaacgccgggcggggacgtgccgttctggggggcgtgtccaccggcgggggcgtgccgtcctgggggcgtggctctctgctccggtgcaggcccgcagggcgccctgggctgggagcaacgcgactgaccgtggtcgtgggcggacggcggctgcagcgtggaggagctggggtcgctgtgggtcgcgaagcagagcccgggacgtgcgcgcttggtgcacgatcctgaaggggagctccgaggggcccgggtcgccagggctgctgcggccattcccggagcccggcgcggggcccgcgagatactggtttaggccgtcccagggctccgggcgcacccggtggccgctgctgcagcggagggagcgcggcggcgcgggggctcggagacagcgtttctcccggaagtcttcctcgggcagcaggtgggaagtgggagccggagcggcagctggcagcgttctctccgcaggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgaggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcagctttctaaaaaacaactccaaagtgaagtctgtttattttgctgtttcccctccatgcctgtgaattggatgttgtggtccctgtagagtgagtgcatgtggcgtacacggggagaaaggagctctcccacgcctgagtggctgttttgtgcttgggataaagctcacagattgtttttttttttctctattaaactcttcagtgccctggtagatcaggcaggcatacttggaatttagacagatggcaccgattcaggggactctcttgctcgagttttcccctcggagcctgttgccttcttggcgcagggaccctgtcaagacgaagagctccacgcatggcaggagcccacgctgatgcctggtgggcctggggggtgtctctagctcagactgggtctgttccatgtgaccagagccccaggacatcgttccttagccagctgctccgttgttggaggcctggtgtggtcacaggtgtgtcctagaacggtgactttgcccctcctgccctaggagatttgggtgtattcacagagcagccatctcctgtctccgtcagagcagtctcttccaggttactggaaggtcagtttctgtcaggcctcacttccttcttatcagagggtagccaggtccctgcactggtatctatttagaaatgtacatggagcccccagcgaaatgtgcctacattgtgtgttccagaaccggaggtacccttaccttctagatatgtgatgacatggctctcacgtcaggcagactgctgcacccacgctctcggcctgccgtgcagggatttcactcgtggagtgaggcatctgggggctgtgcagtgaggagctttccatgtgttgttaagacaacctgttagcattgtcttctcccgcgtctcctggcctcttctctctttaaatccttttctctgtttgtcttaatcacattaacgtcctatttatgttttattcaatatacatttaaaatagaacttactatgtgccaggcattgtgttcaacacgtgaaatatttaatccttagaataaccatattgtcagcataatttacaa

SEQ ID NO: 72530 - DNA, 1937 bp, Homo sapiens
tcgacggctcattggtttttgttgctgaaaatattccattgtttggatgtacactttatcccttcacctataacagcttgtattttcgtgtgcagttttatgattactcaaattgcacttgtagatatatcttaacaaacacttcatacaaaataagcataggattattttattcaccaaagtattgttaattagcagagctcaattctttggtgtcagtttatcaaatttaccttctaggttttgagtttattattaagaacctgcgtagacttattttattttttaatgcataggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcagctttctaaaaaacaactccaaagtgaagtctgtttattttgctgtttcccctccatgcctgtgaattggatgttgtggtccctgtagagtgagtgcatgtggcgtacacggggagaaaggagctctcccacgcctgagtggctgttttgtgcttgggataaagctcacagattgtttttttttttctctattaaactcttcagtgccctggtagatcaggcaggcatacttggaatttagacagatggcaccgattcaggggactctcttgctcgagttttcccctcggagcctgttgccttcttggcgcagggaccctgtcaagacgaagagctccacgcatggcaggagcccacgctgatgcctggtgggcctggggggtgtctctagctcagactgggtctgttccatgtgaccagagccccaggacatcgttccttagccagctgctccgttgttggaggcctggtgtggtcacaggtgtgtcctagaacggtgactttgcccctcctgccctaggagatttgggtgtattcacagagcagccatctcctgtctccgtcagagcagtctcttccaggttactggaaggtcagtttctgtcaggcctcacttccttcttatcagagggtagccaggtccctgcactggtatctatttagaaatgtacatggagcccccagcgaaatgtgcctacattgtgtgttccagaaccggaggtacccttaccttctagatatgtgatgacatggctctcacgtcaggcagactgctgcacccacgctctcggcctgccgtgcagggatttcactcgtggagtgaggcatctgggggctgtgcagtgaggagctttccatgtgttgttaagacaacctgttagcattgtcttctcccgcgtctcctggcctcttctctctttaaatccttttctctgtttgtcttaatcacattaacgtcctatttatgttttattcaatatacatttaaaatagaacttactatgtgccaggcattgtgttcaacacgtgaaatatttaatccttagaataaccatattgtcagcataatttacaa

SEQ ID NO: 72531 - DNA, 3680 bp, Homo sapiens
ctcctgcctcggcctctctgagccaaccacggggcggggcgtgaacgccgggcggggacgtgccgttctggggggcgtgtccaccggcgggggcgtgccgtcctgggggcgtggctctctgctccggtgcaggcccgcagggcgccctgggctgggagcaacgcgactgaccgtggtcgtgggcggacggcggctgcagcgtggaggagctggggtcgctgtgggtcgcgaagcagagcccgggacgtgcgcgcttggtgcacgatcctgaaggggagctccgaggggcccgggtcgccagggctgctgcggccattcccggagcccggcgcggggcccgcgagatactggtttaggccgtcccagggctccgggcgcacccggtggccgctgctgcagcggagggagcgcggcggcgcgggggctcggagacagcgtttctcccggaagtcttcctcgggcagcaggtgggaagtgggagccggagcggcagctggcagcgttctctccgcaggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacaggtgggtgcgcccttcccccggctgcacttcccagtggggatctctgctgtcgcccaagcctgacagctggatccaggggagtgggtgtagacctcactgccctccagcagcttctgcatgtgcactattcggctactgggatcattcctgaggaatgttctgagcctaccaagcctttccagatcattctacatcacgatcacacagagtgggtgcagagtattgggatgcccatctgggcaccatctcatcatcagagtcggccatagggaaaacgaggactccaaccagcatgtgccgaactctgtggccaagacagtctgacaataagttattgcccacagaggatgtctaagtctttgtgtccactctgtgatcgtgatctagaattttctaccaaggcttgatggggaactaggatattcttctgcaatgattcagaattttacagtgtacctttatactttaataagtgaattctatatatggtagtttggtaggattctgtgtagaagtgctttaggaggtgattgaaagctgtagggacttaccatacggttatgtattgcttggtgatggggtataaaattgtcatgtgaacatcttggagtgcacttacttagctgatacagcccacgacacacatatgctttgtggtatagcctgttgcttcgaggctacaaacctgtacagtgtgtgactctactgagtactgtaggcacctgtatgtaacacaatggtaaggatttgtgtatctaaacatatctcaacatagaaaaggcacagtagaaatgtggtcatatgggaccgccctcgtacatgcaggccttcactgactgaatgtcgtaatgtggcgcatgactgtgtttaaagatttgtccaaatgcagtttaccaggataagcctggaatccgatttcaattgctgtcttttaaagcaggtgtggcaaacgggtggtgatgtgtgtgccagctccactcggtggtggccccagcgctcccatgctccgaaggagtcaggaactggaaagggtacctgcctggagcagtttgtgtgtgtgctaaggggtggggaaggcggggactgggaaccatgtatttgcagtccatgttgacacatttgttgcataaagtcatagaaaacactttcctttaagagtgtcttaatttttaccatgaaatatgatacctgaaaagaacaagaaagcaaagtggaccttcattatacagctaacttttttaaatttaaattttagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcagctttctaaaaaacaactccaaagtgaagtctgtttattttgctgtttcccctccatgcctgtgaattggatgttgtggtccctgtagagtgagtgcatgtggcgtacacggggagaaaggagctctcccacgcctgagtggctgttttgtgcttgggataaagctcacagattgtttttttttttctctattaaactcttcagtgccctggtagatcaggcaggcatacttggaatttagacagatggcaccgattcaggggactctcttgctcgagttttcccctcggagcctgttgccttcttggcgcagggaccctgtcaagacgaagagctccacgcatggcaggagcccacgctgatgcctggtgggcctggggggtgtctctagctcagactgggtctgttccatgtgaccagagccccaggacatcgttccttagccagctgctccgttgttggaggcctggtgtggtcacaggtgtgtcctagaacggtgactttgcccctcctgccctaggagatttgggtgtattcacagagcagccatctcctgtctccgtcagagcagtctcttccaggttactggaaggtcagtttctgtcaggcctcacttccttcttatcagagggtagccaggtccctgcactggtatctatttagaaatgtacatggagcccccagcgaaatgtgcctacattgtgtgttccagaaccggaggtacccttaccttctagatatgtgatgacatggctctcacgtcaggcagactgctgcacccacgctctcggcctgccgtgcagggatttcactcgtggagtgaggcatctgggggctgtgcagtgaggagctttccatgtgttgttaagacaacctgttagcattgtcttctcccgcgtctcctggcctcttctctctttaaatccttttctctgtttgtcttaatcacattaacgtcctatttatgttttattcaatatacatttaaaatagaacttactatgtgccaggcattgtgttcaacacgtgaaatatttaatccttagaataaccatattgtcagcataatttacaa

SEQ ID NO: 72532 - DNA, 2379 bp, Homo sapiens
ctcctgcctcggcctctctgagccaaccacggggcggggcgtgaacgccgggcggggacgtgccgttctggggggcgtgtccaccggcgggggcgtgccgtcctgggggcgtggctctctgctccggtgcaggcccgcagggcgccctgggctgggagcaacgcgactgaccgtggtcgtgggcggacggcggctgcagcgtggaggagctggggtcgctgtgggtcgcgaagcagagcccgggacgtgcgcgcttggtgcacgatcctgaaggggagctccgaggggcccgggtcgccagggctgctgcggccattcccggagcccggcgcggggcccgcgagatactggtttaggccgtcccagggctccgggcgcacccggtggccgctgctgcagcggagggagcgcggcggcgcgggggctcggagacagcgtttctcccggaagtcttcctcgggcagcaggtgggaagtgggagccggagcggcagctggcagcgttctctccgcaggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacaggttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcagctttctaaaaaacaactccaaagtgaagtctgtttattttgctgtttcccctccatgcctgtgaattggatgttgtggtccctgtagagtgagtgcatgtggcgtacacggggagaaaggagctctcccacgcctgagtggctgttttgtgcttgggataaagctcacagattgtttttttttttctctattaaactcttcagtgccctggtagatcaggcaggcatacttggaatttagacagatggcaccgattcaggggactctcttgctcgagttttcccctcggagcctgttgccttcttggcgcagggaccctgtcaagacgaagagctccacgcatggcaggagcccacgctgatgcctggtgggcctggggggtgtctctagctcagactgggtctgttccatgtgaccagagccccaggacatcgttccttagccagctgctccgttgttggaggcctggtgtggtcacaggtgtgtcctagaacggtgactttgcccctcctgccctaggagatttgggtgtattcacagagcagccatctcctgtctccgtcagagcagtctcttccaggttactggaaggtcagtttctgtcaggcctcacttccttcttatcagagggtagccaggtccctgcactggtatctatttagaaatgtacatggagcccccagcgaaatgtgcctacattgtgtgttccagaaccggaggtacccttaccttctagatatgtgatgacatggctctcacgtcaggcagactgctgcacccacgctctcggcctgccgtgcagggatttcactcgtggagtgaggcatctgggggctgtgcagtgaggagctttccatgtgttgttaagacaacctgttagcattgtcttctcccgcgtctcctggcctcttctctctttaaatccttttctctgtttgtcttaatcacattaacgtcctatttatgttttattcaatatacatttaaaatagaacttactatgtgccaggcattgtgttcaacacgtgaaatatttaatccttagaataaccatattgtcagcataatttacaa

SEQ ID NO: 72533 - DNA, 2304 bp, Homo sapiens
ctcctgcctcggcctctctgagccaaccacggggcggggcgtgaacgccgggcggggacgtgccgttctggggggcgtgtccaccggcgggggcgtgccgtcctgggggcgtggctctctgctccggtgcaggcccgcagggcgccctgggctgggagcaacgcgactgaccgtggtcgtgggcggacggcggctgcagcgtggaggagctggggtcgctgtgggtcgcgaagcagagcccgggacgtgcgcgcttggtgcacgatcctgaaggggagctccgaggggcccgggtcgccagggctgctgcggccattcccggagcccggcgcggggcccgcgagatactggtttaggccgtcccagggctccgggcgcacccggtggccgctgctgcagcggagggagcgcggcggcgcgggggctcggagacagcgtttctcccggaagtcttcctcgggcagcaggtgggaagtgggagccggagcggcagctggcagcgttctctccgcaggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcagctttctaaaaaacaactccaaagtgaagtctgtttattttgctgtttcccctccatgcctgtgaattggatgttgtggtccctgtagagtgagtgcatgtggcgtacacggggagaaaggagctctcccacgcctgagtggctgttttgtgcttgggataaagctcacagattgtttttttttttctctattaaactcttcagtgccctggtagatcaggcaggcatacttggaatttagacagatggcaccgattcaggggactctcttgctcgagttttcccctcggagcctgttgccttcttggcgcagggaccctgtcaagacgaagagctccacgcatggcaggagcccacgctgatgcctggtgggcctggggggtgtctctagctcagactgggtctgttccatgtgaccagagccccaggacatcgttccttagccagctgctccgttgttggaggcctggtgtggtcacaggtgtgtcctagaacggtgactttgcccctcctgccctaggagatttgggtgtattcacagagcagccatctcctgtctccgtcagagcagtctcttccaggttactggaaggtcagtttctgtcaggcctcacttccttcttatcagagggtagccaggtccctgcactggtatctatttagaaatgtacatggagcccccagcgaaatgtgcctacattgtgtgttccagaaccggaggtacccttaccttctagatatgtgatgacatggctctcacgtcaggcagactgctgcacccacgctctcggcctgccgtgcagggatttcactcgtggagtgaggcatctgggggctgtgcagtgaggagctttccatgtgttgttaagacaacctgttagcattgtcttctcccgcgtctcctggcctcttctctctttaaatccttttctctgtttgtcttaatcacattaacgtcctatttatgttttattcaatatacatttaaaatagaacttactatgtgccaggcattgtgttcaacacgtgaaatatttaatccttagaataaccatattgtcagcataatttacaa

SEQ ID NO: 72534 - DNA, 1743 bp, Homo sapiens
ctcctgcctcggcctctctgagccaaccacggggcggggcgtgaacgccgggcggggacgtgccgttctggggggcgtgtccaccggcgggggcgtgccgtcctgggggcgtggctctctgctccggtgcaggcccgcagggcgccctgggctgggagcaacgcgactgaccgtggtcgtgggcggacggcggctgcagcgtggaggagctggggtcgctgtgggtcgcgaagcagagcccgggacgtgcgcgcttggtgcacgatcctgaaggggagctccgaggggcccgggtcgccagggctgctgcggccattcccggagcccggcgcggggcccgcgagatactggtttaggccgtcccagggctccgggcgcacccggtggccgctgctgcagcggagggagcgcggcggcgcgggggctcggagacagcgtttctcccggaagtcttcctcgggcagcaggtgggaagtgggagccggagcggcagctggcagcgttctctccgcaggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagtaagtcttgcttttgcttcttttctcgtgtgtctctcccggggacctccagtagggccgtttcagcctctgagtcaatgggctgtaaattgccccagtgcaaacccccttcctacttaaatgttatcatgtgaacagattttatttgcattttattttcctgcgcatgttgagtaggagctgaaggctgcttagaccagtgatttggaagcacagatttcatggctccctttgtgagaagtgtgtgctccagggtccggcagagcaggtggaatctgcagtttgaagagtcacattcacttttataacgtagtcttatatttgtttgtggtttgttttcatgataaaattgtgatttgttttatgataaaagaaactatagatatttaagcatgacaagatgttattagctggtaagcatatacaaaaagttgctttttgccaggtgtggtgactcacgcctataaatcccaggaccttgggaggctcaggctggaggattgcttgtggctagaatttcgagaccagcctgggcagcagagtgagacctctagaaagaagtaaaagtagctgagcatgatagtatgtgtctgtggtctcagctattcaggaagctaaggtcagaggattgcctgcgcccaggaatttgaggctgcagtgagccatggtcgccccactgcactccagtctgggcgacagccagatcacgtctctttaaaaaaaaaaga

SEQ ID NO: 72535 - DNA, 1566 bp, Homo sapiens
ctcctgcctcggcctctctgagccaaccacggggcggggcgtgaacgccgggcggggacgtgccgttctggggggcgtgtccaccggcgggggcgtgccgtcctgggggcgtggctctctgctccggtgcaggcccgcagggcgccctgggctgggagcaacgcgactgaccgtggtcgtgggcggacggcggctgcagcgtggaggagctggggtcgctgtgggtcgcgaagcagagcccgggacgtgcgcgcttggtgcacgatcctgaaggggagctccgaggggcccgggtcgccagggctgctgcggccattcccggagcccggcgcggggcccgcgagatactggtttaggccgtcccagggctccgggcgcacccggtggccgctgctgcagcggagggagcgcggcggcgcgggggctcggagacagcgtttctcccggaagtcttcctcgggcagcaggtgggaagtgggagccggagcggcagctggcagcgttctctccgcaggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagagctgaaggctgcttagaccagtgatttggaagcacagatttcatggctccctttgtgagaagtgtgtgctccagggtccggcagagcaggtggaatctgcagtttgaagagtcacattcacttttataacgtagtcttatatttgtttgtggtttgttttcatgataaaattgtgatttgttttatgataaaagaaactatagatatttaagcatgacaagatgttattagctggtaagcatatacaaaaagttgctttttgccaggtgtggtgactcacgcctataaatcccaggaccttgggaggctcaggctggaggattgcttgtggctagaatttcgagaccagcctgggcagcagagtgagacctctagaaagaagtaaaagtagctgagcatgatagtatgtgtctgtggtctcagctattcaggaagctaaggtcagaggattgcctgcgcccaggaatttgaggctgcagtgagccatggtcgccccactgcactccagtctgggcgacagccagatcacgtctctttaaaaaaaaaaga

SEQ ID NO: 72536 - DNA, 1325 bp, Homo sapiens
ctcctgcctcggcctctctgagccaaccacggggcggggcgtgaacgccgggcggggacgtgccgttctggggggcgtgtccaccggcgggggcgtgccgtcctgggggcgtggctctctgctccggtgcaggcccgcagggcgccctgggctgggagcaacgcgactgaccgtggtcgtgggcggacggcggctgcagcgtggaggagctggggtcgctgtgggtcgcgaagcagagcccgggacgtgcgcgcttggtgcacgatcctgaaggggagctccgaggggcccgggtcgccagggctgctgcggccattcccggagcccggcgcggggcccgcgagatactggtttaggccgtcccagggctccgggcgcacccggtggccgctgctgcagcggagggagcgcggcggcgcgggggctcggagacagcgtttctcccggaagtcttcctcgggcagcaggtgggaagtgggagccggagcggcagctggcagcgttctctccgcaggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtcaccagggaagaaccatctactgtcctgtcctgaagggagttcctcctagatctggtcggacctttgtatgaccacagaggaggatctcaacctggatgtggagcccaccacagaagacactgcagaagaagtaactatacacgttttattacactctgctttgtttggggagattgggcccagaaggtggtgaagggggaaatggaagtttgaaattaaatatctgtgagcagttattttagtgacatatgtgtctctatacatacacatgcacaaacgtgtatatatgcatatgtacatatcatgtgcttattatattcggtaatctccctcaaaaagaatagctggagcata

SEQ ID NO: 72537 - DNA, 3139 bp, Homo sapiens
aggaatgttggtgctcccagcacctagcaccgggagactggagaggtttccaggagagtgacccgagtaggtcccctcctaattctggagccgtccctcgggctgcgcagtggagcgccgaggtggcgggaggctgcggggagcctgcgcggccaagcaccatctgcagtcaggagctcccgggcagcttgcagggcgcagtttttgaaagcgggtgctgcgtgcggaccgcgggcctgcagggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacaggtgggtgcgcccttcccccggctgcacttcccagtggggatctctgctgtcgcccaagcctgacagctggatccaggggagtgggtgtagacctcactgccctccagcagcttctgcatgtgcactattcggctactgggatcattcctgaggaatgttctgagcctaccaagcctttccagatcattctacatcacgatcacacagagtgggtgcagagtattgggatgcccatctgggcaccatctcatcatcagagtcggccatagggaaaacgaggactccaaccagcatgtgccgaactctgtggccaagacagtctgacaataagttattgcccacagaggatgtctaagtctttgtgtccactctgtgatcgtgatctagaattttctaccaaggcttgatggggaactaggatattcttctgcaatgattcagaattttacagtgtacctttatactttaataagtgaattctatatatggtagtttggtaggattctgtgtagaagtgctttaggaggtgattgaaagctgtagggacttaccatacggttatgtattgcttggtgatggggtataaaattgtcatgtgaacatcttggagtgcacttacttagctgatacagcccacgacacacatatgctttgtggtatagcctgttgcttcgaggctacaaacctgtacagtgtgtgactctactgagtactgtaggcacctgtatgtaacacaatggtaaggatttgtgtatctaaacatatctcaacatagaaaaggcacagtagaaatgtggtcatatgggaccgccctcgtacatgcaggccttcactgactgaatgtcgtaatgtggcgcatgactgtgtttaaagatttgtccaaatgcagtttaccaggataagcctggaatccgatttcaattgctgtcttttaaagcaggtgtggcaaacgggtggtgatgtgtgtgccagctccactcggtggtggccccagcgctcccatgctccgaaggagtcaggaactggaaagggtacctgcctggagcagtttgtgtgtgtgctaaggggtggggaaggcggggactgggaaccatgtatttgcagtccatgttgacacatttgttgcataaagtcatagaaaacactttcctttaagagtgtcttaatttttaccatgaaatatgatacctgaaaagaacaagaaagcaaagtggaccttcattatacagctaacttttttaaatttaaattttagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcagctttctaaaaaacaactccaaagtgaagtctgtttattttgctgtttcccctccatgcctgtgaattggatgttgtggtccctgtagagtgagtgcatgtggcgtacacggggagaaaggagctctcccacgcctgagtggctgttttgtgcttgggataaagctcacagattgtttttttttttctctattaaactcttcagtgccctggtagatcaggcaggcatacttggaatttagacagatggcaccgattcaggggactctcttgctcgagttttcccctcggagcctgttgccttcttggcgcagggaccctgtcaagacgaagagctccacgcatggcaggagcccacgctgatgcctggtgggcctggggggtgtctctagctcagactgggtctgttccatgtgaccagagccccaggacatcgttccttagccagctgctccgttgttggaggcctggtgtggtcacaggtgtgtcctagaacggtgactttgcccctcctgccctaggagatttgggtgtattcacagagcagccatctcctgtctccgtcagagcagtctcttccaggttactggaaggtcagtttctgtcaggcctcacttccttcttatcagagggtagccaggtccctgcactggtatctatttagaaatgtacatggagcccccagcgaaatgtgcctacattgtgtgttccagaaccggaggtacccttaccttctagatatgtgatgacatggctctcacgtcaggcagactgctgcacccacgctctcggcctgccgtgcagggatttcactcgtggagtgaggcatctgggggctgtgcagtgaggagctttccatgtgttgttaagacaacctgttagcattgtcttctcccgcgtctcctggcctcttctctctttaaatccttttctctgtttgtcttaatcacattaacgtcctatttatgttttattcaatatacatttaaaatagaacttactatgtgccaggcattgtgttcaacacgtgaaatatttaatccttagaataaccatattgtcagcataatttacaa

SEQ ID NO: 72538 - DNA, 1446 bp, Homo sapiens
aagtttaatttctaatacacttgtatttaaaatcaggttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcagctttctaaaaaacaactccaaagtgaagtctgtttattttgctgtttcccctccatgcctgtgaattggatgttgtggtccctgtagagtgagtgcatgtggcgtacacggggagaaaggagctctcccacgcctgagtggctgttttgtgcttgggataaagctcacagattgtttttttttttctctattaaactcttcagtgccctggtagatcaggcaggcatacttggaatttagacagatggcaccgattcaggggactctcttgctcgagttttcccctcggagcctgttgccttcttggcgcagggaccctgtcaagacgaagagctccacgcatggcaggagcccacgctgatgcctggtgggcctggggggtgtctctagctcagactgggtctgttccatgtgaccagagccccaggacatcgttccttagccagctgctccgttgttggaggcctggtgtggtcacaggtgtgtcctagaacggtgactttgcccctcctgccctaggagatttgggtgtattcacagagcagccatctcctgtctccgtcagagcagtctcttccaggttactggaaggtcagtttctgtcaggcctcacttccttcttatcagagggtagccaggtccctgcactggtatctatttagaaatgtacatggagcccccagcgaaatgtgcctacattgtgtgttccagaaccggaggtacccttaccttctagatatgtgatgacatggctctcacgtcaggcagactgctgcacccacgctctcggcctgccgtgcagggatttcactcgtggagtgaggcatctgggggctgtgcagtgaggagctttccatgtgttgttaagacaacctgttagcattgtcttctcccgcgtctcctggcctcttctctctttaaatccttttctctgtttgtcttaatcacattaacgtcctatttatgttttattcaatatacatttaaaatagaacttactatgtgccaggcattgtgttcaacacgtgaaatatttaatccttagaataaccatattgtcagcataatttacaa

SEQ ID NO: 72539 - DNA, 1255 bp, Homo sapiens
tcgacggctcattggtttttgttgctgaaaatattccattgtttggatgtacactttatcccttcacctataacagcttgtattttcgtgtgcagttttatgattactcaaattgcacttgtagatatatcttaacaaacacttcatacaaaataagcataggattattttattcaccaaagtattgttaattagcagagctcaattctttggtgtcagtttatcaaatttaccttctaggttttgagtttattattaagaacctgcgtagacttattttattttttaatgcataggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagtaagtcttgcttttgcttcttttctcgtgtgtctctcccggggacctccagtagggccgtttcagcctctgagtcaatgggctgtaaattgccccagtgcaaacccccttcctacttaaatgttatcatgtgaacagattttatttgcattttattttcctgcgcatgttgagtaggagctgaaggctgcttagaccagtgatttggaagcacagatttcatggctccctttgtgagaagtgtgtgctccagggtccggcagagcaggtggaatctgcagtttgaagagtcacattcacttttataacgtagtcttatatttgtttgtggtttgttttcatgataaaattgtgatttgttttatgataaaagaaactatagatatttaagcatgacaagatgttattagctggtaagcatatacaaaaagttgctttttgccaggtgtggtgactcacgcctataaatcccaggaccttgggaggctcaggctggaggattgcttgtggctagaatttcgagaccagcctgggcagcagagtgagacctctagaaagaagtaaaagtagctgagcatgatagtatgtgtctgtggtctcagctattcaggaagctaaggtcagaggattgcctgcgcccaggaatttgaggctgcagtgagccatggtcgccccactgcactccagtctgggcgacagccagatcacgtctctttaaaaaaaaaaga

SEQ ID NO: 72540 - DNA, 2425 bp, Homo sapiens
ctcctgcctcggcctctctgagccaaccacggggcggggcgtgaacgccgggcggggacgtgccgttctggggggcgtgtccaccggcgggggcgtgccgtcctgggggcgtggctctctgctccggtgcaggcccgcagggcgccctgggctgggagcaacgcgactgaccgtggtcgtgggcggacggcggctgcagcgtggaggagctggggtcgctgtgggtcgcgaagcagagcccgggacgtgcgcgcttggtgcacgatcctgaaggggagctccgaggggcccgggtcgccagggctgctgcggccattcccggagcccggcgcggggcccgcgagatactggtttaggccgtcccagggctccgggcgcacccggtggccgctgctgcagcggagggagcgcggcggcgcgggggctcggagacagcgtttctcccggaagtcttcctcgggcagcaggtgggaagtgggagccggagcggcagctggcagcgttctctccgcaggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcagctttctaaaaaacaactccaaagtgaagtctgtttattttgctgtttcccctccatgcctgtgaattggatgttgtggtccctgtagagtgagtgcatgtggcgtacacggggagaaaggagctctcccacgcctgagtggctgttttgtgcttgggataaagctcacagattgtttttttttttctctattaaactcttcagtgccctggtagatcaggcaggcatacttggaatttagacagatggcaccgattcaggggactctcttgctcgagttttcccctcggagcctgttgccttcttggcgcagggaccctgtcaagacgaagagctccacgcatggcaggagcccacgctgatgcctggtgggcctggggggtgtctctagctcagactgggtctgttccatgtgaccagagccccaggacatcgttccttagccagctgctccgttgttggaggcctggtgtggtcacaggtgtgtcctagaacggtgactttgcccctcctgccctaggagatttgggtgtattcacagagcagccatctcctgtctccgtcagagcagtctcttccaggttactggaaggtcagtttctgtcaggcctcacttccttcttatcagagggtagccaggtccctgcactggtatctatttagaaatgtacatggagcccccagcgaaatgtgcctacattgtgtgttccagaaccggaggtacccttaccttctagatatgtgatgacatggctctcacgtcaggcagactgctgcacccacgctctcggcctgccgtgcagggatttcactcgtggagtgaggcatctgggggctgtgcagtgaggagctttccatgtgttgttaagacaacctgttagcattgtcttctcccgcgtctcctggcctcttctctctttaaatccttttctctgtttgtcttaatcacattaacgtcctatttatgttttattcaatatacatttaaaatagaacttactatgtgccaggcattgtgttcaacacgtgaaatatttaatccttagaataaccatattgtcagcataatttacaa

SEQ ID NO: 72541 - DNA, 2154 bp, Homo sapiens
aggaatgttggtgctcccagcacctagcaccgggagactggagaggtttccaggagagtgacccgagtaggtcccctcctaattctggagccgtccctcgggctgcgcagtggagcgccgaggtggcgggaggctgcggggagcctgcgcggccaagcaccatctgcagtcaggagctcccgggcagcttgcagggcgcagtttttgaaagcgggtgctgcgtgcggaccgcgggcctgcagggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcagctttctaaaaaacaactccaaagtgaagtctgtttattttgctgtttcccctccatgcctgtgaattggatgttgtggtccctgtagagtgagtgcatgtggcgtacacggggagaaaggagctctcccacgcctgagtggctgttttgtgcttgggataaagctcacagattgtttttttttttctctattaaactcttcagtgccctggtagatcaggcaggcatacttggaatttagacagatggcaccgattcaggggactctcttgctcgagttttcccctcggagcctgttgccttcttggcgcagggaccctgtcaagacgaagagctccacgcatggcaggagcccacgctgatgcctggtgggcctggggggtgtctctagctcagactgggtctgttccatgtgaccagagccccaggacatcgttccttagccagctgctccgttgttggaggcctggtgtggtcacaggtgtgtcctagaacggtgactttgcccctcctgccctaggagatttgggtgtattcacagagcagccatctcctgtctccgtcagagcagtctcttccaggttactggaaggtcagtttctgtcaggcctcacttccttcttatcagagggtagccaggtccctgcactggtatctatttagaaatgtacatggagcccccagcgaaatgtgcctacattgtgtgttccagaaccggaggtacccttaccttctagatatgtgatgacatggctctcacgtcaggcagactgctgcacccacgctctcggcctgccgtgcagggatttcactcgtggagtgaggcatctgggggctgtgcagtgaggagctttccatgtgttgttaagacaacctgttagcattgtcttctcccgcgtctcctggcctcttctctctttaaatccttttctctgtttgtcttaatcacattaacgtcctatttatgttttattcaatatacatttaaaatagaacttactatgtgccaggcattgtgttcaacacgtgaaatatttaatccttagaataaccatattgtcagcataatttacaa

SEQ ID NO: 72542 - DNA, 4146 bp, Homo sapiens
agcagcgagtccttgcctcccggcggctcaggacgagggcagatctcgttctggggcaagccgttgacactcgctccctgccaccgcccgggctccgtgccgccaagttttcattttccaccttctctgcctccagtcccccagcccctggccgagagaagggtcttaccggccgggattgctggaaacaccaagaggtggtttttgttttttaaaacttctgtttcttgggagggggtgtggcggggcaggatgagcaactccgttcctctgctctgtttctggagcctctgctattgctttgctgcggggagccccgtaccttttggtccagagggacggctggaagataagctccacaaacccaaagctacacagactgaggtcaaaccatctgtgaggtttaacctccgcacctccaaggacccagagcatgaaggatgctacctctccgtcggccacagccagcccttagaagactgcagtttcaacatgacagctaaaacctttttcatcattcacggatggacgatgagcggtatctttgaaaactggctgcacaaactcgtgtcagccctgcacacaagagagaaagacgccaatgtagttgtggttgactggctccccctggcccaccagctttacacggatgcggtcaataataccagggtggtgggacacagcattgccaggatgctcgactggctgcaggagaaggacgatttttctctcgggaatgtccacttgatcggctacagcctcggagcgcacgtggccgggtatgcaggcaacttcgtgaaaggaacggtgggccgaatcacaggtttggatcctgccgggcccatgtttgaaggggccgacatccacaagaggctctctccggacgatgcagattttgtggatgtcctccacacctacacgcgttccttcggcttgagcattggtattcagatgcctgtgggccacattgacatctaccccaatgggggtgacttccagccaggctgtggactcaacgatgtcttgggatcaattgcatatggaacaatcacagaggtggtaaaatgtgagcatgagcgagccgtccacctctttgttgactctctggtgaatcaggacaagccgagttttgccttccagtgcactgactccaatcgcttcaaaaaggggatctgtctgagctgccgcaagaaccgttgtaatagcattggctacaatgccaagaaaatgaggaacaagaggaacagcaaaatgtacctaaaaacccgggcaggcatgcctttcagagtttaccattatcagatgaaaatccatgtcttcagttacaagaacatgggagaaattgagcccaccttttacgtcaccctttatggcactaatgcagattcccagactctgccactggaaatagtggagcggatcgagcagaatgccaccaacaccttcctggtctacaccgaggaggacttgggagacctcttgaagatccagctcacctgggagggggcctctcagtcttggtacaacctgtggaaggagtttcgcagctacctgtctcaaccccgcaaccccggacgggagctgaatatcaggcgcatccgggtgaagtctggggaaacccagcggaaactgacattttgtacagaagaccctgagaacaccagcatatccccaggccgggagctctggtttcgcaagtgtcgggatggctggaggatgaaaaacgaaaccagtcccactgtggagcttccctgagggtgcccgggcaagtcttgccagcaaggcagcaagacttcctgctatccaagcccatggaggaaagttactgctgaggacccacccaatggaaggattcttctcagccttgaccctggagcactgggaacaactggtctcctgtgatggctgggactcctcgcgggaggggactgcgctgctatagctcttgctgcctctcttgaatagctctaactccaaacctctgtccacacctccagagcaccaagtccagatttgtgtgtaagcagctgggtgcctggggcctctcgtgcacactggattggtttctcagttgctgggcgagcctgtactctgcctgacgaggaacgctggctccgaagaggccctgtgtagaaggctgtcagctgctcagcctgctttgagcctcagtgagaagtccttccgacaggagctgactcatgtcaggatggcaggcctggtatcttgctcgggccctagctgttggggttctcatgggttgcactgaccatactgcttacgtcttagccattccgtcctgctccccagctcactctctgaagcacacatcattggctttcctatttttctgttcattttttaattgagcaaatgtctattgaacacttaaaattaattagaatgtggtaatggacatattactgagcctctccatttggaacccagtggagttgggatttctagaccctctttctgtttggatggtgtatgtgtatatgcatggggaaaggcacctggggcctgggggaggctataggatataagcattagggaccctgaggctttaagtggtttctatttcttcttagttattatgtgccaccttcttagttattatgtgccacctcccctatgagtgacgtgtttgatcactagcagaatagcaagcagagtatcattcatgctggggccagaatgatggccggttgccagatataactgctttggagcaaatctcttctgtttagagagatagaagttatgacatatgtaatacacatctgtgtacacagaaaccggcacctgccagacagagctggttctaagatttaatacagtgctttttttcctctttgaaatattttactttaataccagtgccttttcttgttgaacttcttggaaaagccaccaattctagatcttgatttgaattaatacacacaatatctgagacacttacacttttcaaaagatttgtgtatgcattgcctaattagagtagggggagaagggcaactattattatccctattttacaaaactgaggcttagtgaggttcagccacatgcctagacttatatactagttagtggtgcagccagggagaggactcagatttcctggaggcaaagtctatctctgaaactccatgaagacttttgcagccagttcccaccaatatgccccagacgtgagacaaacaaggacttttttttttatatagagccatccataaaatcctaagcccttttattaatgtataaccaggagaacatctgtgccaacggttggactttttatggctgagattcgggaggaagtgtgacaccaagcaggagaggaagaatgattttctttgtacttaggttttctaaggacattgttttaatctgtatcgtgccaaagttgtatcactgttaaacttctgaagacataaccagttgagtcttatttcaagatatgttctcaagccaattgtgtgcttctcttgtttctgtgattgctttctagccaaagcgaagcttgtacaggttgagtatcccttatccaaaatgcttggaaccagaagtgtttcaaattttagattattttcagattttggaatgtttgcatatacataatgagatattttgggaataggacccgagcctaaacacaaaattcattgatgtgtcagttacaccttatccacatagcctgagggtaattttatacgatattttaaatagttgtgtacatgaagcatggtttgtggtaacttatgtgaggggttttcccattttttgtcttgttggtgctcaaaaagttttggattttggagcatttcggattttggatttttggattagggttgctcaacccatattattggctgtacatcctggtcacttctgacttctgtttttactaatggaagctttgcaaattgaattctcagtgagttgtatatttatacacctggcttgaagccttaattgtatataatgatgctttttaaaaaatgctatttggaagactatttatttctcgtgtatataatgtatataaaaaaatatggttagtgtttacctaaggttaaccaatttcaagattaaaatttttaaatagtaaaataataaaaaattataaagttcttaatggtc

SEQ ID NO: 72543 - DNA, 2393 bp, Homo sapiens
tattccaacactacttactatccaagagaggcagcaagacttcctgctatccaagcccatggaggaaagttactgctgaggacccacccaatggaaggattcttctcagccttgaccctggagcactgggaacaactggtctcctgtgatggctgggactcctcgcgggaggggactgcgctgctatagctcttgctgcctctcttgaatagctctaactccaaacctctgtccacacctccagagcaccaagtccagatttgtgtgtaagcagctgggtgcctggggcctctcgtgcacactggattggtttctcagttgctgggcgagcctgtactctgcctgacgaggaacgctggctccgaagaggccctgtgtagaaggctgtcagctgctcagcctgctttgagcctcagtgagaagtccttccgacaggagctgactcatgtcaggatggcaggcctggtatcttgctcgggccctagctgttggggttctcatgggttgcactgaccatactgcttacgtcttagccattccgtcctgctccccagctcactctctgaagcacacatcattggctttcctatttttctgttcattttttaattgagcaaatgtctattgaacacttaaaattaattagaatgtggtaatggacatattactgagcctctccatttggaacccagtggagttgggatttctagaccctctttctgtttggatggtgtatgtgtatatgcatggggaaaggcacctggggcctgggggaggctataggatataagcattagggaccctgaggctttaagtggtttctatttcttcttagttattatgtgccaccttcttagttattatgtgccacctcccctatgagtgacgtgtttgatcactagcagaatagcaagcagagtatcattcatgctggggccagaatgatggccggttgccagatataactgctttggagcaaatctcttctgtttagagagatagaagttatgacatatgtaatacacatctgtgtacacagaaaccggcacctgccagacagagctggttctaagatttaatacagtgctttttttcctctttgaaatattttactttaataccagtgccttttcttgttgaacttcttggaaaagccaccaattctagatcttgatttgaattaatacacacaatatctgagacacttacacttttcaaaagatttgtgtatgcattgcctaattagagtagggggagaagggcaactattattatccctattttacaaaactgaggcttagtgaggttcagccacatgcctagacttatatactagttagtggtgcagccagggagaggactcagatttcctggaggcaaagtctatctctgaaactccatgaagacttttgcagccagttcccaccaatatgccccagacgtgagacaaacaaggacttttttttttatatagagccatccataaaatcctaagcccttttattaatgtataaccaggagaacatctgtgccaacggttggactttttatggctgagattcgggaggaagtgtgacaccaagcaggagaggaagaatgattttctttgtacttaggttttctaaggacattgttttaatctgtatcgtgccaaagttgtatcactgttaaacttctgaagacataaccagttgagtcttatttcaagatatgttctcaagccaattgtgtgcttctcttgtttctgtgattgctttctagccaaagcgaagcttgtacaggttgagtatcccttatccaaaatgcttggaaccagaagtgtttcaaattttagattattttcagattttggaatgtttgcatatacataatgagatattttgggaataggacccgagcctaaacacaaaattcattgatgtgtcagttacaccttatccacatagcctgagggtaattttatacgatattttaaatagttgtgtacatgaagcatggtttgtggtaacttatgtgaggggttttcccattttttgtcttgttggtgctcaaaaagttttggattttggagcatttcggattttggatttttggattagggttgctcaacccatattattggctgtacatcctggtcacttctgacttctgtttttactaatggaagctttgcaaattgaattctcagtgagttgtatatttatacacctggcttgaagccttaattgtatataatgatgctttttaaaaaatgctatttggaagactatttatttctcgtgtatataatgtatataaaaaaatatggttagtgtttacctaaggttaaccaatttcaagattaaaatttttaaatagtaaaataataaaaaattataaagttcttaatggtc

SEQ ID NO: 72544 - DNA, 3446 bp, Homo sapiens
gcaatgtggtgaaaccctgtatctacaaaaactacaaaaattagccaggtgtggtggtcatgtgcctgtcgtcccagatactggggaggctgaggtgagaggatcacctgaatctcggaagttgaggctgctgtgagcggggggtcgtgattgtcccactgcactctaacctgggcaagagtgagaccttgtctcaacacaaataaacaagcaaaagaattacatgaaaatactaacagcaacaataaacagctatcactgttgaggagtacagtatttattatttgagtgtctaatcatcaagaagggctcatcctgcatgctttttatctctcccacccccagcaatcacagaggtggtaaaatgtgagcatgagcgagccgtccacctctttgttgactctctggtgaatcaggacaagccgagttttgccttccagtgcactgactccaatcgcttcaaaaaggggatctgtctgagctgccgcaagaaccgttgtaatagcattggctacaatgccaagaaaatgaggaacaagaggaacagcaaaatgtacctaaaaacccgggcaggcatgcctttcagagtttaccattatcagatgaaaatccatgtcttcagttacaagaacatgggagaaattgagcccaccttttacgtcaccctttatggcactaatgcagattcccagactctgccactggaaatagtggagcggatcgagcagaatgccaccaacaccttcctggtctacaccgaggaggacttgggagacctcttgaagatccagctcacctgggagggggcctctcagtcttggtacaacctgtggaaggagtttcgcagctacctgtctcaaccccgcaaccccggacgggagctgaatatcaggcgcatccgggtgaagtctggggaaacccagcggaaactgacattttgtacagaagaccctgagaacaccagcatatccccaggccgggagctctggtttcgcaagtgtcgggatggctggaggatgaaaaacgaaaccagtcccactgtggagcttccctgagggtgcccgggcaagtcttgccagcaaggcagcaagacttcctgctatccaagcccatggaggaaagttactgctgaggacccacccaatggaaggattcttctcagccttgaccctggagcactgggaacaactggtctcctgtgatggctgggactcctcgcgggaggggactgcgctgctatagctcttgctgcctctcttgaatagctctaactccaaacctctgtccacacctccagagcaccaagtccagatttgtgtgtaagcagctgggtgcctggggcctctcgtgcacactggattggtttctcagttgctgggcgagcctgtactctgcctgacgaggaacgctggctccgaagaggccctgtgtagaaggctgtcagctgctcagcctgctttgagcctcagtgagaagtccttccgacaggagctgactcatgtcaggatggcaggcctggtatcttgctcgggccctagctgttggggttctcatgggttgcactgaccatactgcttacgtcttagccattccgtcctgctccccagctcactctctgaagcacacatcattggctttcctatttttctgttcattttttaattgagcaaatgtctattgaacacttaaaattaattagaatgtggtaatggacatattactgagcctctccatttggaacccagtggagttgggatttctagaccctctttctgtttggatggtgtatgtgtatatgcatggggaaaggcacctggggcctgggggaggctataggatataagcattagggaccctgaggctttaagtggtttctatttcttcttagttattatgtgccaccttcttagttattatgtgccacctcccctatgagtgacgtgtttgatcactagcagaatagcaagcagagtatcattcatgctggggccagaatgatggccggttgccagatataactgctttggagcaaatctcttctgtttagagagatagaagttatgacatatgtaatacacatctgtgtacacagaaaccggcacctgccagacagagctggttctaagatttaatacagtgctttttttcctctttgaaatattttactttaataccagtgccttttcttgttgaacttcttggaaaagccaccaattctagatcttgatttgaattaatacacacaatatctgagacacttacacttttcaaaagatttgtgtatgcattgcctaattagagtagggggagaagggcaactattattatccctattttacaaaactgaggcttagtgaggttcagccacatgcctagacttatatactagttagtggtgcagccagggagaggactcagatttcctggaggcaaagtctatctctgaaactccatgaagacttttgcagccagttcccaccaatatgccccagacgtgagacaaacaaggacttttttttttatatagagccatccataaaatcctaagcccttttattaatgtataaccaggagaacatctgtgccaacggttggactttttatggctgagattcgggaggaagtgtgacaccaagcaggagaggaagaatgattttctttgtacttaggttttctaaggacattgttttaatctgtatcgtgccaaagttgtatcactgttaaacttctgaagacataaccagttgagtcttatttcaagatatgttctcaagccaattgtgtgcttctcttgtttctgtgattgctttctagccaaagcgaagcttgtacaggttgagtatcccttatccaaaatgcttggaaccagaagtgtttcaaattttagattattttcagattttggaatgtttgcatatacataatgagatattttgggaataggacccgagcctaaacacaaaattcattgatgtgtcagttacaccttatccacatagcctgagggtaattttatacgatattttaaatagttgtgtacatgaagcatggtttgtggtaacttatgtgaggggttttcccattttttgtcttgttggtgctcaaaaagttttggattttggagcatttcggattttggatttttggattagggttgctcaacccatattattggctgtacatcctggtcacttctgacttctgtttttactaatggaagctttgcaaattgaattctcagtgagttgtatatttatacacctggcttgaagccttaattgtatataatgatgctttttaaaaaatgctatttggaagactatttatttctcgtgtatataatgtatataaaaaaatatggttagtgtttacctaaggttaaccaatttcaagattaaaatttttaaatagtaaaataataaaaaattataaagttcttaatggtc

SEQ ID NO: 72545 - DNA, 852 bp, Homo sapiens
agcagcgagtccttgcctcccggcggctcaggacgagggcagatctcgttctggggcaagccgttgacactcgctccctgccaccgcccgggctccgtgccgccaagttttcattttccaccttctctgcctccagtcccccagcccctggccgagagaagggtcttaccggccgggattgctggaaacaccaagaggtggtttttgttttttaaaacttctgtttcttgggagggggtgtggcggggcaggatgagcaactccgttcctctgctctgtttctggagcctctgctattgctttgctgcggggagccccgtaccttttggtccagagggacggctggaagataagctccacaaacccaaagctacacagactgaggtcaaaccatctgtgaggtttaacctccgcacctccaaggacccagagcatgaaggatgctacctctccgtcggccacagccagcccttagaagactgcagtttcaacatgacagctaaaacctttttcatcattcacggatggacgatgagcggtatctttgaaaactggctgcacaaactcgtgtcagccctgcacacaagagagaaagacgccaatgtagttgtggttgactggctccccctggcccaccagctttacacggatgcggtcaataataccagggtggtgggacacagcattgccaggatgctcgactggctgcaggtactgggggatgagagggagtctcctgtcaccagcaggatctcaaacccaatcttcttaagaaatgcaggtcatgcatctgttgccatgaacttctggagtctgataaaaatctttgagattaaaagttttattgaatta

SEQ ID NO: 72546 - DNA, 807 bp, Homo sapiens
ttccacagtatatattattatataataaaatgcttagaatatacacacagtaactaaacactacttataaaatatggctctagatatgtttgataaatatttccttcatgaaaacatggaggaattaattagcagtatctctctgcagcctttagccctcgagaatcatgtagaaaagagggagctgtcttctcttttagcagaacatctgtcagagatggtttcccctgacttagacaattgtgtttttttcccttcagaatgattgagtctcagaattgttctttaatcctcagtatttccattaagaagagcttctatcaagtgcttcaaaagtacccaatgtgaaggagtaataatgactccctgctggtgagcgaagtgtggaggacacaggtccctcagccgtccactggatgctgcactgtttggcctgagccaacatgggcagaaatacaggcggcagcataagcagatgccaagaacctgtcttgcttctactgttttcattgggttactatatctcctttgtagtccaacctgcaaattactttgagaaggggagatacacccctggaccaatctaggactatatttgttcccttgctaaagtaggaaaaaaaatacagaacctttaaatattgaactcaagggcaactaatttaaattcctttcctttcatgttgaaagtcttttgactgggttattctgaagccatagcaattaggttacagtttacttctctgttactttaccatctttaaatttggcaccttcaaaaggttgttctgtgcgtttaaaaaaaaa

SEQ ID NO: 72547 - DNA, 372 bp, Homo sapiens
caggcactgggttacactgggccttgtacctccagcacctcaaaaggagccaggaacctcataaggacctagaaatgcccaccaccatcctaatctgtaaaatggatcagccccttcaggcctagaggggtggggtagggggctgggctaggcaggaagaggggacttagagggtgtcactgattcgtgcagcccctcccaccatctgaccaactctcaagggcatggagtcacttattcattcaacaaacatcaggtcagacatggtggctcacacctgtaatccgaccatgctgggaagccaaggcaagaggatgacttgagctcaggagtttgagatcagcctgggcaacacagggaaaccctacctct

SEQ ID NO: 72548 - DNA, 537 bp, Homo sapiens
tgttacaaatggacttaaaaaaaatcagtgacagtgtgacatagtgaaaagaacagtgagttgaatgtaagaagacccacatgttaagtcttattttgctctattactagttgtgtagtcttcaataatttacttgttccttttggtgatgaacattgaattcattcctactcttttttttctgatacttacagtactattaaaatagttagattaattaagatagaaaggaactgtagcatctgaagatttgagaatttttcccaaattaaatacagagtaatcaatgaaagactttagagcattaaactgttacattaggacaaattctctgaaggaagtggaatggaaatacaagcttaaggaggaagatgcagtgtaaaatttccaattgttagaggtttgcccattaattaattaattatttttgagctggagtcttcctctgtcacccaggctggagcacagttgcagtgagctgagatcgtgccattgcactccagcctgagtgacagagcaagactgtctcaaaaagac

SEQ ID NO: 72549 - DNA, 280 bp, Homo sapiens
gatagcaggagctgagcagtgtcttgtaaccctcttgagttcatgctcatgattgcagctccaagcatcacttcttcacctcagcatcataaggaggaagaaaggatagaaaagaggtcattcctctgacaacactcttattttgggggatagaagatctctactctaaaacccccagtggacttctctttatatcccattggccagaagtggggcacgtgtccactccaagaccaattattggcaagaagcgacggagttaacatgagtggtttacaac

SEQ ID NO: 72550 - DNA, 389 bp, Homo sapiens
gaaaataaaactaaaaaaaaagtaaaagatatgattaattcagtaaaaatattaacagtaaaactactacacattatattaatataaataacatactttaaatgtaaaccactatatttcccaaaacaatcaaagaaataaagccatctaatgagaagaatgccactgttttacattttcataaatttatggcctctgtctgacttaatagaagatgactggattctcaaatctgcttctgcatttaatctgttgtaatatgttagtttggttaaaatatacaaagaaaatctggctttacacagacagagaaagtatctggcattttcagataattttgggatattctttaggcgctacatgcaaaacttgacaagtagtagtttctt

SEQ ID NO: 72551 - DNA, 363 bp, Homo sapiens
gtcttggtacaattattagttcattgtgtgtctggaagtatttgaagtatatagggtatgccccccactaaagcataatttaacttaatcaattgagatgctcatcaaatttcaagaccaatctttattcagtagactaatttgcattgcataattcaaagtaatcagggccagttgaaatttagaagcttttaaaagagaataatatttaataagaacaaataaaagtttaggccctcagggaagaaacataaaccattactcagtgtgaagaggacaagctcagctagaggtttctggtaaggggggtaaacataaatttgtaacataatgcagtgggaatctcacctctttatagtggct

SEQ ID NO: 72552 - DNA, 465 bp, Homo sapiens
caaagattaagccatgcatgtctaagtacgcacagccaagaaaagcctgatatttacatttgtactggcctccaaaggatgtgcaaaactctgagaggagagcgatgcttggattaaaatgattttatttttaatagactttttggtgcagtgttagacttacagaaagttaagcagaaagtacagagttgccttatgttcccattctcccactattttcttctactatcagaatcttgcgctagtgtggtacatttgttacgattgatgaaccaatattactacattattattaaccaacgtccatggtttacattaggattcactctttggattgcacattctaaggatttttaacagatatgtagagatatttatccaccattaccatattatatagaataggtttactacccggaaaattccctgtgctccttctatttctcccttcctcctcccaaatcc

SEQ ID NO: 72553 - DNA, 362 bp, Homo sapiens
gaggttgcagtgagctgagatcctgccactgcactccagcctgggcgaaacagtgagattccatgtcaataaataaataaataaataataaaattagcccctacacctcccactgtttgttattctttatctcataatcttattactttactatacctatcactatctgaaattgtcttatttttatacttatttacttgcttgttatttatttccttacaaatagaatgaaagctccatgagagtaaagaccttgtttgtcttgtttaccactgtgtctttgtcttatggtaaacagtactggtacatagtaggttctcaataattatatattggatgaactaataaactgaataaatcat

SEQ ID NO: 72554 - DNA, 517 bp, Homo sapiens
agatgcagtttttgcatttgtcgcccaggctggagtgcaatggcaccatctcagctcactgcgacctctgcctcttggtttcgagcaattctcctgcctcagcctcccgagtagccgggattacaggcacccaccaccatgcctggctactttttttttatttttagtagagacggggtttcacctcaggtgatccacctgcctcagccttccaaagtgttgggattacagccatgagccactgcgcccagctggggaagcgacttttgaagagtaaattacttattctgtataagttcagtacagaatcccaggtctgtagctcccaattaagatagatcattttttacatgaaggtcacccctctacaggactcatctctttggtgccctctatctttgagaatctaggtctcttatattactcagaacacactacccatatctatccttccatgcgcattgttccatctcaggccctaatctcctccttaagccttcaatcccatcctctatct

SEQ ID NO: 72555 - DNA, 323 bp, Homo sapiens
gatcttgaactcctgggctccagtgatctgcctgcctcagcctcccaaaatgctgggattataggtgtgagccactgcgccttgctgatggcatcttagaaataaagaaatactaagtaaactcatactttattttactttttacttttctctgtgaaaatgttaacaagtcattcaatatctgtggtactcaatttatttgtaaaatggggatgatgatagcccagttaataagctaccttagcaatttcttaggcttggtctgaagctatatgaaataacttttaaagagcaaagcactcttaaaattcagattttattat

SEQ ID NO: 72556 - DNA, 272 bp, Homo sapiens
tattaaaatccataataaactttcccaaatataggccggtgcctaccttcaggagtgcattctgtcatttgggactaaatattctatgttccgtgggggaaagatatttttaaaaacactgacctatacactaggagttctcactccagcaacaataggtgtgtgaggataaagccttctaaaattgcgcacacatctggggaggaagcgcgcgtgagcagttttctgggtgaagcattcataatgtttctcagcttctcaaaggaatgtgt

SEQ ID NO: 72557 - DNA, 1143 bp, Homo sapiens
aattgagttttaggaaactcagactactttttctcaatgtagcttttccttcatagataggcaattctggttcaaccaggaattgtgatgacatcataaacacgtaaactcttagcaatttatttattttaaaatattctcttagagtgctttttacttactatctgttccaaaagaaaccccctcaaaggagaatagagttcactgctctttgggacaagattacctttatatccagcagttatcaaagttggtttagattatggcctcaagcaaattttactaaaatgtgaaaatatgccaccttccaagtcagaaataaactttggagtatgttcatttaaagagtttttacatatttataattgaatttccacaattagaataaacagttgcatgtctttttgtactttgttaaataatgaaatggaagtaatgacaatataacttcaggattgttatttctctacaaggtaaagcactttaagagatcaaattatacataataaaatattaagctttttaaatgataaactctaatactggcatgtattgcaatgaacgagttcacacactcatatcttgtggattataaaatgacattattcttttggaaagtattatgtataagaaccataagaagttcatactctttgattcattaattctagtcttaggaaacgatgcttgaaaaacagtttttaaaaagtgtattcagtttagctaatgtttgtcacgtacctcatacgaattagacactgtggtgggagctgcagattaaaaaaatgaaaggtttaatgttattagaagaaagatgtttattgcagtcttattaaagaggaaaagaaaaatggaacaaccttgatgttcaacaatttgtgaatgctgttaaattaatattttggcatattatgcagctttaaaagtgataattgtacatactttaggaaaatgtagagaaaatttaagtaaaaaaaattaattacatcagcactagaattatgtatttaaaaagtcttatagaccagggacagtggctcatgcctataatcccagcactttgggaggttgaggcgggagaattgcttgagtccaggagttcaagaccagccagggcagcatagctataccctcatccctacc

SEQ ID NO: 72558 - DNA, 319 bp, Homo sapiens
ggtaaagagctttgtcttactttgatgaaaggtttttgaagtgtctgttgattagtgtttgctactattatcagaatttacaaagtttgttttcccttttggaaaatatattaaggctaaaaaaagtgtaagttaattacatagccattgaggggttaaacgtgcattgtgattgagactgaatagtgttttcccaacctttccctttttacaatggagaaaacaggtaattaaattttgtacagtaaaatgtcaattgaacatttattgccaaataacacctcaggcatagcagggcattatgaaaagatatcaggag

SEQ ID NO: 72559 - DNA, 1010 bp, Homo sapiens
cgaaaggatcatacagtactataggcctgccacatgggcacaagacgactcatagggataccatacccccatctacatgctcaactggatcatacggttacaggccatcttagaaataatcactagtgaaactggcagagctttaactcttttagcccagcaggaaacccaaatgagaaatgccatctatcagaatagattggccttagactatttgctggcagctgaaggaggagtctgtgaaaaattcaacttgaccaagtgctgtctgcaaagagatgatcaaggacaagtagtcaaaaatatagttagagacatgacaaagctggcacatgtacccatgcaggtttggcataggtttgatcctggatccctgtttggaaaatggcttccagctctaggaggatttaaaactcttataataggaatgataatggtgttaggaacctgcatgttactcccctgtatgttacccatatttctccagttactaagaagcttcgttatcaccttagttcatcaaaagacctcagcacaagtatactacatgaatcactattgatctgtctcacaggaagatctagatagtgaggatgataatgagaactcccactagtgagtgaggttctcaaaggggggaatgaggagagaggccatttctcctactgtcccctatctccaaagaaaaggaggaagtaaaaactgaaaaaataacagactgatcagcaccactggccaggcccgtaggttaaagattaacccacaccctaaccgcttgtgctgtctatagatcacagacaatggtatggagaaacacttgccttgctcaccacccccacctagccatgtaccccatgcttgttcaatctatcacgaccctttcatgtggaccccttagagctgtaagcccttaaaagggccaagaactctttctctgggactcagttcttgagacgcaagcctgccgatgctcctggccgaataaagcctcttccttctttaacccagtg

SEQ ID NO: 72560 - DNA, 329 bp, Homo sapiens
gattgatcagttgactaaggtgataaccctgctagcatttccattgtaaaagtacattttctgttttttggttagcacataatctgtgatgatacttggctgtgtgcaaatatcctttttttcccccaacaaccattgagctaatgtttttggcatcccttgcttactctttcctgaattcattatttcatgggagttgcaaaatggtgattttcctaattctaccattcctttcacatttatttgctggtattaaagaaaagcttccctcattcaccttagatgaactatataatatctcctatagaggcagggcaaatgccctttaa

SEQ ID NO: 72561 - DNA, 414 bp, Homo sapiens
gccatctgaagaaatgtatagtagtatcccattgtcattttaatttgcattatcctgatgactgatgatgttaagcatttttatgtgcatattaaccatccacatttttttctttgttaaagtgtctgttcaaatctttagcccattttatactgagttgtttgttttcttattactgggttttgagaattctttatatttctggatacaagtattttatcagatgtaggattagaaaatatttctcctgattctagggcttggctttctattgtcttaagtgtgtcttccaaaggccaggaatttttaattttgatgtttaatttattagttttttttttttcttttacaaatcaaggttttggtgtcatatttaagaaatctttgaacaacacacactgtggcctgttggca

SEQ ID NO: 72562 - DNA, 817 bp, Homo sapiens
ttggaaatacagtgaagtctggcacaatacaaaaacgtacacctgtatttaattttacactgatctttttaaagcatagggtttaaggtacagatttctctgcaaacacagtttagctgcatttcacacattttgatatgctgaatttgccacatagtttataatttttctaatttctcacaaatttcaaaaagtgttttgatcaaaggttgaaatcccagagggtttaggataaatttttaaaaaatacttgacattgaggattcccttgaagtaaatgatactagaagaaataaaagaactgacacctaaaaaaaaaagaggtaatgaaataaaagttgaaagtgagacttgggaaaaaataagaagatggatctatagatttattaatggaagttgggatatagatgggaatttagctcatatctattgttaaagaaaaatcatcaaaattttatggagcaaaaggactataatatcattgccaattgtactctaatttttatatgaacacagcttttgttgttgttgtttttgaaacagcattttgcttttttgcccaggctggagtgcagtggcatgatcacggttcactgcaaccttgaactcctgagctcaagcagtcctcccaccttagcctcctaagaagcctggactacaagcagaagctacctcgcccagctaattttttaatttttagtagagacaaggtctcgctgtgttgaataggctgatcttgaatttctgggttcaagcaatcctgccttggcctcccacaatgctgggattacaggcgtgagccatcctgccaagtcca

SEQ ID NO: 72563 - DNA, 417 bp, Homo sapiens
aacaacacccatttattagcccacagttctgtaggtcagaagtctggatcagcttggctaggttttctgctcagagtctcacaagctgttggccaaaatgggctcttacctggaggctcaggggaagaatagccttccatgctcattcacgttgacagaatccagttccttgcaggtgtatgtctaagttccttgctggctgtcaggtggagacactcactgctcccagaagccatctgtatttcttttcatgtgtgcatgtcaaaatcgcctagtgcttaaaatccctgacttccccttgtggctgctcttttgctaccacccagagaaagttctctgcttttaaagactcctgtgattagattacctcacccagataatctcttctcctcaggtcagctatgccatataacatga

SEQ ID NO: 72564 - DNA, 436 bp, Homo sapiens
tattcattttttaaaacttaagttcaagtgtcaccaaaggggcaccttgaccgacaccactcaaccctcatccaagtggatactaactcctctttctcttttttcccaaggcatgaagggcccttctctgctggcattcacactgtactgtgctgaattattgaccagattttagctctttgtaagacaagcacctttcctcatttggctttctacttccagcactcggtgcaatgcttattacatgccaggcactgtcctaactgatgggggttaatgaatggtacaatctaccaagattcaacccaaagtcatcaacatttcttagatcctttcttctccaagttctgatatctaaacactaaattagtgattcataaaatgtttaaataatttgaataatttaaaaaatttaatcttaaataatttaatcttg

SEQ ID NO: 72565 - DNA, 915 bp, Homo sapiens
cacatttcttgcagcattattcaaggtacccaatttatggaagcaacataagtgcctattagcgaatggatcgatgagaaagatgtggtgtatatgtacacaatgaaatactgttcagcctttattaattgattgatcgagacagggtctcactctgtcactcaggctggagtgcagtggattgaccagggctcactgcagcctcaaactcccaggctcagatgatcctcccaccatagtctcccttgtagcttctgggagcacaggcacgcacacacccagccttttttgttgttgttgttgtagagatggggtctcactgtgtggcccaggctggtcttgaactcctgggctcaagcaatcctcctgccttggcctgacaaagtgctgagattaaaggcgtaaaacaacatgcccatgtccccaaagaaggaaattctgtcattttcaacaacgtggacaaacctgaaggacattgtgctaagtaaataagccagggacagaaagacaaacaccatctcacttatgtggaatctaaaacaattgaactcatagaagcagagagtagaatggtgtttaccagaggcggggggccgaggggaatggaggagatgatagtcagagggcatgaagtttctgttaggaggaatacatttttttgagatttattgcaaagcatggtgaccatagttgttaatactgtgtattttgcaattctgagggagcagatttcaaatgttctcaccataaaacataaaaatttgaggcaatggatactaattagcttgatttaatgtgtccacattgtatacgatatcataacatcagttttgtacccataaatatagtttgtcaatgtaaattttgaaaattttttttcatgaattgaagtaaacaagatcataatatacattg

SEQ ID NO: 72566 - DNA, 398 bp, Homo sapiens
tgaaattagttaatggtgatggttgcacaactctgtatatactaaaaaccattgaattgcacattctaaatgggtgaatttatttgttgtgactttaatctgaataatgctgttaaaaaagaacttttatattccatttcaataatcatccaacgtggtagatgtttgcattatattttcatatcatatgaatcagtagcattgggaaagagagaagaggacaagatccaaggcccaggctcaaaaaatgtttggagcttggtttttttcttgccaagtcattcctggtatcatctggatgaggggaacggctcctgtttattttccccaatcaatcagtaaacatagttagatttgtttgtgacagttttcctgccatgcttcagttcagaaactaa

SEQ ID NO: 72567 - DNA, 257 bp, Homo sapiens
caggattggcgaggctgagaagggtatctctgccctgcatcaatcagctatgggagtgtgtccttccttaagctgtgtaacactgggaaagttacttgacctctttttgcctctgtttaattacctgtgaaagggagatgatcatagtacctgcctctggaggaattgttgtgactgggtctttaagttccagttggtgtttaatactgtttggacctagaacatgtgtaatttggaaactccctctaggcacttct

SEQ ID NO: 72568 - DNA, 447 bp, Homo sapiens
ggttcccatgagccccttaagatctgaggagagtctggaagcggtggctcatgcctgtaatccaagcactttgggaggccgaggtgggtggatcagctgaggtcaggagtttgagactagccatggccaacatggtaaaaccctgtgtctactaaaaatacaaaaattagctgggcatggtggtggctgcctgtaatcccagctactctggaggctgaggcaggagaattgcttgaacctgggaggtggaggttacagtgagcagagatcgcgccactgcattccaacctgggggacaagagcaaaactccatctcaaaaaaaagaaaaaagaaaaatctgaggagagagtttaatgaggtgagctgcatgcttggattagaagatgccagaagtatgatggaatgcagcaacttggatggaaacgtccagtggtccgccccatggc

SEQ ID NO: 72569 - DNA, 299 bp, Homo sapiens
aatcctttgttgtgctaagacatgcaaacaactgacactgaataacataatttattatttgcatttgacatgtcacattaaaggctagatgggcacattgttgttgtttttttttaaatcagtcatctgattatattttcttgcttattgaaattaaaccgagctcataattaacatccaattaacactaccaggtgaagtactttagtgttgtctcttctctaagtaacagtgattttcttctgatggccttctacttcttggaaggtcagcaggtccccaattcagactcttgttcc

SEQ ID NO: 72570 - DNA, 2071 bp, Homo sapiens
aggcagcgagagacacgaggagcaaagcaagtgaaggcacagacgcacgggacaggagagcctgggcaagactggagagcccagacctgggatggcggattcgtgcaggaacctcacctacgtgcggggctcggtggggccggccaccagcaccctgatgttcgtggccggtgtggtgggcaacgggctggccctgggcatcctgagcgcacggcgaccggcgcgcccctcggccttcgcggtgctggtcaccggactggcggccaccgacctgctgggcaccagcttcctgagcccggccgtgttcgtggcctatgcgcgcaacagctccctgctgggcctggcccgaggcggccccgccctgtgcgatgccttcgccttcgccatgaccttcttcggcctggcgtccatgctcatcctctttgccatggccgtggagcgctgcctggcgctgagccacccctacctctacgcgcagctggacgggccccgctgcgcccgcctggcgctgccagccatctacgccttctgcgtcctcttctgcgcgctgcccctgctgggcctgggccaacaccagcagtactgccccggcagctggtgcttcctccgcatgcgctgggcccagccgggcggcgccgccttctcgctggcctacgccggcctggtggccctgctggtggctgccatcttcctctgcaacggctcggtcaccctcagcctctgccgcatgtaccgccagcagaagcgccaccagggctctctgggtccacggccgcgcaccggagaggacgaggtggaccacctgatcctgctggccctcatgacagtggtcatggccgtgtgctccctgcctctcacgatccgctgcttcacccaggctgtcgcccctgacagcagcagtgagatgggggacctccttgccttccgcttctacgccttcaaccccatcctggacccctgggtcttcatccttttccgcaaggctgtcttccagcgactcaagctctgggtctgctgcctgtgcctcgggcctgcccacggagactcgcagacacccctttcccagctcgcctccgggaggagggacccaagggccccctctgctcctgtgggaaaggaggggagctgcgtgcctttgtcggcttggggcgaggggcaggtggagcccttgcctcccacacagcagtccagcggcagcgccgtgggaacgtcgtccaaagcagaagccagcgtcgcctgctccctctgctgacatttcaagctgaccctgtgatctctgccctgtcttcgggcgacaggagccagaaaatcagggacatggctgatggctgcggatgctggaaccttggcccccaaactctggggccgatcagctgctgtttctcctgcggcagggcagtcgctgctggctctgggaagagagtgagggacagaggaaacgtttatcctggagtgcagaaagaatggttctctcaaaataaccagtggcctggccgacctgctctggccctggattccccatccatctcattgtctaaatatttagaaggcggagaagttcccagaggcttctgtacagtcaggtctgctctggtctgggtgctggctccaatctgcgtccacttaggaggcccaactgcccaccccaagtccccaggggatggccctccccctctaccaagccactccaagagccagcccctttctgctccacaaaaaccacagttattggaaaagctccctgccttcccttgccgctggtcccccaccaggcttgggagccctggcatcccaaaggggcaacgggaggaaggggaggctgctgcattgtgggtgatgacgtaggacatgtgcttggtacaaaaagggcctgagacattccacctagcttgactggctgcaagatgagaactgggggggtgcaggtggtggggagacagatggagaagctggcagatgaagggtgggggctgcggatcccagggactgccccagaacacaaacctaagtcctgtgcctgtccccagggtcctgaataaataaaagcctccttgcagagcctgacctcatg

SEQ ID NO: 72571 - DNA, 745 bp, Homo sapiens
caacaccagcagtactgccccggcagctggtgcttcctccgcatgcgctgggcccagccgggcggcgccgccttctcgctggcctacgccggcctggtggccctgctggtggctgccatcttcctctgcaacggctcggtcaccctcagcctctgccgcatgtaccgccagcagaagcgccaccagggctctctgggtccacggccgcgcaccggagaggacgaggtggaccacctgatcctgctggccctcatgacagtggtcatggccgtgtgctccctgcctctcacggtgagtcccctccggagctgggaggagtggggagaggaggagggcagctctgtgggttgtgcccatgtcacagatggggagactgaggctcaaaagaggtgagacatcgtgggcatggtggctcacgcctgtaatcccagcatgtagaaaggccgaggcaggaccggatgcggtggctcacacctgtaatcccagcactttgggaggccgaggccggcggatcatttgaggtcaggagttcgagaccagtctggccaacatgatgaaaccctgtctctactaaaaatacaacaaataaataaataaaaagtagccggacgtagtggcacatgcctgaagtcccagctacttgggaggctgagccaggagaatcgcttgaaccccggaggcggaggttgcagtgagctgagatcgtgccactgcactatagcctgggtgacagagtgagaccccg

SEQ ID NO: 72572 - DNA, 288 bp, Homo sapiens
agagaattggtacttgtcatcattctgccatctgcaaaagctggattcccctgcccctgcttttctttattaaatataattttattttttgctttggttttagactgcttttagacagagaatatccatatatccctcccctagctttcccttctgttaacatcttaatacagttatccagtagtccgtggtacatgttatccaatcatatttatgtagttatcaaaaccaggaaacattggtttgatgctattaactaaaaatcttactcagattttaccagttttc

SEQ ID NO: 72573 - DNA, 425 bp, Homo sapiens
ccacacatggtccctttttggcagcacctctgtctggctggagcaggccctgctctgtctgctttgtagaggtcagagtcttctgtttcatggcacagtggcatcatgggctcaagtaactttggcagcttcaattccaaagacttggcaaaaagaaagcagaagagagaggagaaacctctttttatttttcttgtcaccattctcctgacctccatcaactagaccccgtttccactatcccagagaaagggtggccacagctaaactgcatggagaaaccaaagaatttaaatattggaattttcaaaagtgtagttgtgggggttcgaggaacatttaaagattattggattctttgtagttttgctgtatgctctaattttaaacttaactcctattacagtgttatctgattttcttat

SEQ ID NO: 72574 - DNA, 1629 bp, Homo sapiens
gatattacccagcatgttgtcatagctgaaggttttctctctagtgcatagtgatgggtgatatctattgaagctgggagggtcacagtatcagtgagtggtcccccaatttcttcttgagcatcgatgaattagcagtggtgtaatattgtggatctgacttcatgtgtcactaagaacaggagatccaagactgctcttctggggatgagacttggaagaaacctccatcctcagggatttgaagaaggttatactggaacctgtgtgaaggctgagacaaccgtcccttttgtggtggcctgaggggattttcttaatcccaatgttgccctgaaatttatgtccaggattcaaaaagtttaggactgctaagagacattactgccgggagtgttgagtgaagggaccaggtggagatgatgcctcaggagcagtacactcaccaccggagcaccatgcctggctctgtggggccacaggtatacaaggtggggatttatggctggcggaaacgatgcctgtatttctttgtcctgctcctcatgattttaatactggtgaacttggccatgaccatctggattctcaaagtcatgaacttcacaattgatggaatgggaaacctgaggatcacagaaaaaggtctaaagctagaaggagactctgaattcttacaacctctctacgccaaagaaatccagtcccgaccaggtaatgccctgtacttcaagtctgccagaaatgttacagtgaacattctcaatgaccagactaaagtgctaactcagcttataacaggtccaaaagccgtagaagcttatggtaaaaaatttgaggtaaaaactgtttctggaaaattgctcttctctgcagacaataatgaagtggtagtaggagctgaaagattacgagttttaggagcggagggcacagtgttccctaaatctatagaaacacctaatgtcagggcagaccccttcaaagaactaaggttggagtccccaacccggtctctagtgatggaggccccaaaaggagtggaaatcaatgcagaagctggcaatatggaagccacctgcaggacagagctgagactggaatccaaagatggagagattaagttagatgctgcgaaaatcaggctacctagactgcctcatggatcctacacgcctacaggaacgaggcagaaggtcttcgagatctgcgtctgcgccaatgggagattattcctgtctcaggcaggagctgggtccacttgtcagataaacacaagtgtctgcctctgaaagactatccatagtggacattgttggcagcataaaggccttttttggctttagacactggctgccagctatttttactagaacacagaaagcctatcaaagaccttgtgtgtatgtgtacgtgtgtgtgcgtgcttgagtgtgttcgcgtgtgtgggtggatataaatatatataaatatatataaataaatatatatatcctctgtataaaatgaggtttcagtacaaaaggaaccatgggtgaccctgcgatatccactgtcattttccatcccatccccaccacctgagtgacagaaatctaaacacacatccgtcccaacattccccagacc

SEQ ID NO: 72575 - DNA, 1476 bp, Homo sapiens
gatattacccagcatgttgtcatagctgaaggttttctctctagtgcatagtgatgggtgatatctattgaagctgggagggtcacagtatcagtgagtggtcccccaatttcttcttgagcatcgatgaattagcagtggtgtaatattgtggatctgacttcatgtgtcactaagaacaggagatccaagactgctcttctggggatgagacttggaagaaacctccatcctcagggatttgaagaaggttatactggaacctgtgtgaaggctgagacaaccgtcccttttgtggtggcctgaggggattttcttaatcccaatgttgccctgaaatttatgtccaggattcaaaaagtttaggactgctaagagacattactgccgggagtgttgagtgaagggaccaggtggagatgatgcctcaggagcagtacactcaccaccggagcaccatgcctggctctgtggggccacaggtatacaaggtggggatttatggctggcggaaacgatgcctgtatttctttgtcctgctcctcatgattttaatactggtgaacttggccatgaccatctggattctcaaagtcatgaacttcacaattgatggaatgggaaacctgaggatcacagaaaaaggtctaaagctagaaggagactctgaattcttacaacctctctacgccaaagaaatccagtcccgaccaggtaatgccctgtacttcaagtctgccagaaatgttacagtgaacattctcaatgaccagactaaagtgctaactcagcttataacaggtccaaaagccgtagaagcttatggtaaaaaatttgaggtaaaaactgtttctggaaaattgctcttctctgcagacaataatgaagtggtagtaggagctgaaagattacgagttttaggagcggagggcacagtgttccctaaatctatagaaacacctaatgtcagggcagaccccttcaaagaactaaggttggagtccccaacccggtctctagtgatggaggccccaaaaggagtggaaatcaatgcagaagctggcaatatggaagccacctgcaggacagagctgagactggaatccaaagatggagaggtgagggatgagaaggacagaagttcaaagagctacagcttcaacaggccaacccttcccataactggttgacctcggagttggatcctacagtgtatcaacaaaaggagccaagcaggttttatttctgaaacaattaattgagcagcatgattataagccaaacccacaatccatcaaagtgatgatttcttatttgtaaaatgcagagataatggcatgtattccaagtacagaattatatgaccatgaaaatgaatgctattttcaaattctctcttgtcaccttaaaataagattttgttagccaacataattaagctgtatatattatacacatctggctcaagatgaaaaa

SEQ ID NO: 72576 - DNA, 1553 bp, Homo sapiens
ttgatagctggagacagcccagtagctgtgagtcggtctgacaaagccatattgaagtacggagtacggtttcaaagcagtcagaaaaagaacgggaatgctgttcaggaaattcttcaggcatgggcagggacttggctgcagttctgcagttggaaaatctgactggggcagcttctgagcgcaggctgggcctgcacacactcagcgggccgagtggccacctccttcagagctgctcagcacgccctgggatcgcgggcggttttcatcggccggtttgtgaaacggacaagagagagacattactgccgggagtgttgagtgaagggaccaggtggagatgatgcctcaggagcagtacactcaccaccggagcaccatgcctggctctgtggggccacaggtatacaaggtggggatttatggctggcggaaacgatgcctgtatttctttgtcctgctcctcatgattttaatactggtgaacttggccatgaccatctggattctcaaagtcatgaacttcacaattgatggaatgggaaacctgaggatcacagaaaaaggtctaaagctagaaggagactctgaattcttacaacctctctacgccaaagaaatccagtcccgaccaggtaatgccctgtacttcaagtctgccagaaatgttacagtgaacattctcaatgaccagactaaagtgctaactcagcttataacaggtccaaaagccgtagaagcttatggtaaaaaatttgaggtaaaaactgtttctggaaaattgctcttctctgcagacaataatgaagtggtagtaggagctgaaagattacgagttttaggagcggagggcacagtgttccctaaatctatagaaacacctaatgtcagggcagaccccttcaaagaactaaggttggagtccccaacccggtctctagtgatggaggccccaaaaggagtggaaatcaatgcagaagctggcaatatggaagccacctgcaggacagagctgagactggaatccaaagatggagagattaagttagatgctgcgaaaatcaggctacctagactgcctcatggatcctacacgcctacaggaacgaggcagaaggtcttcgagatctgcgtctgcgccaatgggagattattcctgtctcaggcaggagctgggtccacttgtcagataaacacaagtgtctgcctctgaaagactatccatagtggacattgttggcagcataaaggccttttttggctttagacactggctgccagctatttttactagaacacagaaagcctatcaaagaccttgtgtgtatgtgtacgtgtgtgtgcgtgcttgagtgtgttcgcgtgtgtgggtggatataaatatatataaatatatataaataaatatatatatcctctgtataaaatgaggtttcagtacaaaaggaaccatgggtgaccctgcgatatccactgtcattttccatcccatccccaccacctgagtgacagaaatctaaacacacatccgtcccaacattccccagacc

SEQ ID NO: 72577 - DNA, 1513 bp, Homo sapiens
ttgatagctggagacagcccagtagctgtgagtcggtctgacaaagccatattgaagtacggagtacggtttcaaagcagtcagaaaaagaacgggaatgctgttcaggaaattcttcaggcatgggcagggacttggctgcagttctgcagttggaaaatctgactggggcagcttctgagcgcaggctgggcctgcacacactcagcgggccgagtggccacctccttcagagctgctcagcacgccctgggatcgcgggcggttttcatcggccggtttgtgaaacggacaagagagagacattactgccgggagtgttgagtgaagggaccaggtggagatgatgcctcaggagcagtacactcaccaccggagcaccatgcctggctctgtggggccacaggtatacaaggtggggatttatggctggcggaaacgatgcctgtatttctttgtcctgctcctcatgattttaatactggtgaacttggccatgaccatctggattctcaaagtcatgaacttcacaattagcatccatctgcttctgagatttaactggctattcagatgttgtggaatgagctgagaggagccagaaccaggagccaggtgactcagattccagtacccactttgctgctggatggaatgggaaacctgaggatcacagaaaaaggtctaaagctagaaggagactctgaattcttacaacctctctacgccaaagaaatccagtcccgaccaggtaatgccctgtacttcaagtctgccagaaatgttacagtgaacattctcaatgaccagactaaagtgctaactcagcttataacaggtccaaaagccgtagaagcttatggtaaaaaatttgaggtaaaaactgtttctggaaaattgctcttctctgcagacaataatgaagtggtagtaggagctgaaagattacgagttttaggagcggagggcacagtgttccctaaatctatagaaacacctaatgtcagggcagaccccttcaaagaactaaggttggagtccccaacccggtctctagtgatggaggccccaaaaggagtggaaatcaatgcagaagctggcaatatggaagccacctgcaggacagagctgagactggaatccaaagatggagaggtgagggatgagaaggacagaagttcaaagagctacagcttcaacaggccaacccttcccataactggttgacctcggagttggatcctacagtgtatcaacaaaaggagccaagcaggttttatttctgaaacaattaattgagcagcatgattataagccaaacccacaatccatcaaagtgatgatttcttatttgtaaaatgcagagataatggcatgtattccaagtacagaattatatgaccatgaaaatgaatgctattttcaaattctctcttgtcaccttaaaataagattttgttagccaacataattaagctgtatatattatacacatctggctcaagatgaaaaa

SEQ ID NO: 72578 - DNA, 770 bp, Homo sapiens
gcacccttctccaacaccaccacttcttggaaattacaatccttgtgtcatctgacctctgcatgcagcccctgatcctgctgatgactcaccaagatctcctttcccttggcttccaggaaccacatactactagatattttcttctttcctctctgactagtccttagtagcctctgaagccaccattccctgttggtgacctcaccccctactcccacagctataattaaaacctaactgcttctagcttccaaatctctaagtccaaacataactcgagtactagacttttacacaccactgtccacaatatatctgcatctaaatatcccactaccactcaaattccaggtgcctaaaatttgagttgagtgaatgcttacatctaattactaggtttccaactacagaggaaatgcagtcccagcatcccagcagcttttgcagtatctctaaacactagtacactagctaacattttctgacgcttttttgagaataggaacttgtagagtcaccatgcctaggtgtgctagttggagggtaaggttttcacctcaggaaagggaagaactggaacagggagtaaaaggaggcctccaggtttagccactctgttaacacttacaggtaattcacataggacaagataaatgtcattatttataaactaactttaaaccacccaaaactatcaccataaaaaagaaatgaaaactgaatgtaaaatattttaaatttcaaataaatactacctttaaaacatt

SEQ ID NO: 72579 - DNA, 394 bp, Homo sapiens
ggcacgagggatcacgtcactgtactccagcctgggcaacaagagcgagactctgtctgaagaaaaaaaaaaaaaaagatgggctggtgcagtcgtcacgcctgtaatccaaggtgctgaaattacaggcatgagccaccaggcctgtaaatgtttcttatcagatttaaagagtgtgttctatcagtaattctaaaagggaggagggtatgttgaggcatgtccggctcccccttcccatcacggcctgaactagttcttcaggttcactttggaaagcccttggcctagaggaggggtccactcagatggctggcaggcttagaattttatttttggtttatagtcactaaagttggtatacaggcgcccactactaaattccactggcttc

SEQ ID NO: 72580 - DNA, 830 bp, Homo sapiens
aagccacaggctccctggctggcgtcagctaaagtggctgttgggtgtccgcaggcttctgcctggccgccgccgcctataagctaccaggaggagctttacgacttcccgtcctgcgggaagtggcgggcacgatcgcaaggtagcgcagaagcttctcaatggccagcgccagctgcagccccggcggcgcactcgcctcacctgagcctgggaggaaaattcttccaaggatgatctcccactcagagctgaggaagcttttctactcagcagatgctgtgtgttttgatgttgacagcacggtcatcagtgaagaaggaatcggatgctttcattggatttggaggaaatgtgatcaggcaacaagtcaaggataacgccaaatggtatatcactgattttgtagagctgctgggagaaccggaagaataacatccattgtcatacagctccaaacaacttcagatgaatttttacaagttacacagattgatactgtttgcttacaattgcctattacaacttgctatagaaagttggtacagatgatctgcactgtcaagtaaactacagttaggaatcctcaaagattggtttgtttgtttttaactgtagttccagtattatatgatcactatcgatttcctggagagttttgtaatctgaattctttatgtatattcctagctatatttcatacaaagtgttttaagagtggagagtcaattaaacacctttactcttaggaatatagattcggcagccttcagtgaatattggtttttttccctttggtatgtcaataaaagtttatccatgtgtcagaa

SEQ ID NO: 72581 - DNA, 857 bp, Homo sapiens
aagccacaggctccctggctggcgtcagctaaagtggctgttgggtgtccgcaggcttctgcctggccgccgccgcctataagctaccaggaggagctttacgacttcccgtcctgcgggaagtggcgggcacgatcgcaaggtagcgcagaagcttctcaatggccagcgccagctgcagccccggcggcgcactcgcctcacctgagcctgggaggaaaattcttccaaggatgatctcccactcagagctgaggaagcttttctactcagcagatgctgtgtgttttgatgttgacagcacggtcatcagtgaagaaggaatcggatgctttcattggatttggaggaaatgtgatcaggcaacaagtcaaggataacgccaaatggtatatcactgattttgtagagctgctgggagaaccggaagaataacatccattgtcatacagctccaaacaacttcagatgaatttttacaagttacacagattgatactgtttgcttacaattgcctattacaacttgctatagaaagttggtacagatgatctgcactgtcaagtaaactacagttaggaatcctcaaagattggtttgtttgtttttaactgtagttccagtattatatgatcactatcgatttcctggagagttttgtaatctgaattctttatgtatattcctagctatatttcatacaaagtgttttaagagtggagagtcaattaaacacctttactcttaggaatatagattcggcagccttcagtgaatattggtttttttccctttggtatgtcaataaaagtttatccatgtgtcagaaaaaacacaagagggaacaacacaaaag

SEQ ID NO: 72582 - DNA, 700 bp, Homo sapiens
gcaagagtattcaggatagattattagtcgtatgaacataaaaaaaaaaaaatttaaagaggcgtttcgccgtgttggccaggatggtctcgatcttctgacctagtgatccgcccgccttggcctcccaaagtgctgggattacaggggtgagctgccgcacccggccttcacctggtatttcatcacaatcaacagatgctttcattggatttggaggaaatgtgatcaggcaacaagtcaaggataacgccaaatggtatatcactgattttgtagagctgctgggagaaccggaagaataacatccattgtcatacagctccaaacaacttcagatgaatttttacaagttacacagattgatactgtttgcttacaattgcctattacaacttgctatagaaagttggtacagatgatctgcactgtcaagtaaactacagttaggaatcctcaaagattggtttgtttgtttttaactgtagttccagtattatatgatcactatcgatttcctggagagttttgtaatctgaattctttatgtatattcctagctatatttcatacaaagtgttttaagagtggagagtcaattaaacacctttactcttaggaatatagattcggcagccttcagtgaatattggtttttttccctttggtatgtcaataaaagtttatccatgtgtcagaa

SEQ ID NO: 72583 - DNA, 863 bp, Homo sapiens
  misc_feature (38)..(38): n is a, c, g, or t
tctctccaacatagcacttccaaaacaaataaaaatanacactaccagaggcgtttcgccgtgttggccaggatggtctcgatcttctgacctagtgatccgcccgccttggcctcccaaagtgctgggattacaggggtgagctgccgcacccggccttcacctggtatttcatcacaatcaacagatgctttcattggatttggaggaaatgtgatcaggcaacaagtcaaggataacgccaaatggtatatcactgattttgtagagctgctgggagaaccggaagaataacatccattgtcatacagctccaaacaacttcagatgaatttttacaagttacacagattgatactgtttgcttacaattgcctattacaacttgctatagaaagttggtacagatgatctgcactgtcaagtaaactacagttaggaatcctcaaagattggtttgtttgtttttaactgtagttccagtattatatgatcactatcgatttcctggagagttttgtaatctgaattctttatgtatattcctagctatatttcatacaaagtgttttaagagtggagagtcaattaaacacctttactcttaggaatatagattcggcagccttcagtgaatattggtttttttccctttggtatgtcaataaaagtttatccatgtgtcagaaaaaaaaaaaaatcggccctcctggccctcacccgcgccaccttctcccgccctttcccctttattggagggcaattcaataaccctcccccactgactccttgcgtcattttattcggacttcgtaagcgttattatttatttaagggcggtttccggtttccccaatacctgg

SEQ ID NO: 72584 - DNA, 705 bp, Homo sapiens
ctaaggctaggtacgaggctgggtggttgcttctcaatggccagcgccagctgcagccccggcggcgcactcgcctcacctgagcctgggaggaaaattcttccaaggatgatctcccactcagagctgaggaagcttttctactcagcagatgctgtgtgttttgatgttgacagcacggtcatcagtgaagaaggaatcggatgctttcattggatttggaggaaatgtgatcaggcaacaagtcaaggataacgccaaatggtatatcactgattttgtagagctgctgggagaaccggaagaataacatccattgtcatacagctccaaacaacttcagatgaatttttacaagttacacagattgatactgtttgcttacaattgcctattacaacttgctatagaaagttggtacagatgatctgcactgtcaagtaaactacagttaggaatcctcaaagattggtttgtttgtttttaactgtagttccagtattatatgatcactatcgatttcctggagagttttgtaatctgaattctttatgtatattcctagctatatttcatacaaagtgttttaagagtggagagtcaattaaacacctttactcttaggaatatagattcggcagccttcagtgaatattggtttttttccctttggtatgtcaataaaagtttatccatgtgtcagaa

SEQ ID NO: 72585 - DNA, 1004 bp, Homo sapiens
aagccacaggctccctggctggcgtcagctaaagtggctgttgggtgtccgcaggcttctgcctggccgccgccgcctataagctaccaggaggagctttacgacttcccgtcctgcgggaagtggcgggcacgatcgcaaggtagcgcagaagcttctcaatggccagcgccagctgcagccccggcggcgcactcgcctcacctgagcctgggaggaaaattcttccaaggatgatctcccactcagagctgaggaagcttttctactcagcagatgctgtgtgttttgatgttgacagcacggtcatcagtgaagaaggaatcggatgctttcattggatttggaggaaatgtgatcaggcaacaagtcaaggataacgccaaatggtatatcactgattttgtagagctgctgggagaaccggaagaataacatccattgtcatacagctccaaacaacttcagatgaatttttacaagttacacagattgatactgtttgcttacaattgcctattacaacttgctatagaaagttggtacagatgatctgcactgtcaagtaaactacagttaggaatcctcaaagattggtttgtttgtttttaactgtagttccagtattatatgatcactatcgatttcctggagagttttgtaatctgaattctttatgtatattcctagctatatttcatacaaagtgttttaagagtggagagtcaattaaacacctttactcttaggaatatagattcggcagccttcagtgaatattggtttttttccctttggtatgtcaataaaagtttatccatgtgtcagaaaaaaaaaaaaatcggccctcctggccctcacccgcgccaccttctcccgccctttcccctttattggagggcaattcaataaccctcccccactgactccttgcgtcattttattcggacttcgtaagcgttattatttatttaagggcggtttccggtttccccaatacctgg

SEQ ID NO: 72586 - DNA, 693 bp, Homo sapiens
tgctgggattacaggcgtgagtcagcgcacccggcctgccaaattgttttttaactattcagtttaaactgtgagagacaccatgtcaaggaagcagtgtgagctagcgtctaaggattgtgaaaactgagcaagtgcccagaactagaaacttcccagccccctgaactcagcctcagggtaagcgagtttaatagtgcttcctttgattttcaaatctgtggaaggtttgtttcagtttttcccagacaaatattgttgggatagtgtttcttttcaaaaatggataggattcaatgctcatcagtgggaagatagtgactcctgaccattttcctcctagctggaaactacagaagactcccaagtatcaggaaatttggagaatttgtacaggaattatattcagagatagcaatttatttactcatcaaagagagctattggatagccaccataaagaccactcattaaaaaacaaaattgcatgatattcttaacattgtctttcactttttttaaccaggcttggtggagtttcaagatgctgatgaacttaaggtctggcgcttgaaagaatcagtgaagcttttcaagtagaggaggtatatttgaatatgtaacctttagtatctacagaatagaggttgcttttttttttttttttttgtccctttcacagtggtagcaagg

SEQ ID NO: 72587 - DNA, 898 bp, Homo sapiens
tgctgggattacaggcgtgagtcagcgcacccggcctgccaaattgttttttaactattcagtttaaactgtgagagacaccatgtcaaggaagcagtgtgagctagcgtctaaggattgtgaaaactgagcaagtgcccagaactagaaacttcccagccccctgaactcagcctcagggtaagcgagtttaatagtgcttcctttgattttcaaatctgtggaaggtttgtttcagtttttcccagacaaatattgttgggatagtgtttcttttcaaaaatggataggattcaatgctcatcagtgggaagatagtgactcctgaccattttcctcctagctggaaactacagaagactcccaagtatcaggaaatttggagaatttgtacaggaattatattcagagatagcaatttatttactcatcaaagagagctattggatagccaccataaagaccactcattaaaaaacaaaattgcatgatattcttaacattgtctttcactttttttaaccaggcttggtggagtttcaagatgctgatgaacttaaggtctggcgcttgaaagaatcagtgaagcttttcaagtagaggagtactctactttgaagaaaggaatggaacagaaggtgtctgcataactaaatggggatctagagaaagtggagactgcctctggagcagggaggtgagtggaccagatcactgtgggcctgggcctactcagctgattttcaagctaaaaccaggggtaacttttcctcttgagacgaaagccatgctcacattctgtgaacagccagagatgtgttcgaaaggcttacttttattttgtactagaaaagattgtctttccaaaatttacctcgtattcataaactggaaagtt

SEQ ID NO: 72588 - DNA, 1456 bp, Homo sapiens
  misc_feature (542)..(542): n is a, c, g, or t
aattccggagaggggttggaggaatggggagcctgtccctttaagccatgcaatcctagtgagattctctgctcttgatactctggcttcctgtcctgtaggacctccctctcctgaggccaccactgggcccccttctgagtgtcccctgagcactctctcagcatgaactgcatatccgacttcttcacctatgagaccaccaagtcggtggttgtgaagagctggaccatcgggatcatcaaccgagtagttcagcttctgatcatctcctactttgtagggtgggttttcttgcacgagaaggcttaccaggtacgggacacagccattgagtcctcggtggtaaccaaggtgaagggctccggactctacgccaacagagtcatggatgtgtctgattacgtgacgccacctcagggcacctcggtctttgtcatcatcaccaagatgattgttactgaaaatcagatgcaaggattctgcccagagagtgaggagaaataccgctgtgtatcagacagccagtgcgggcctgagcncttgccaggtggggggatcctcactggccgctgcgtgaactacagctctgtgctccggacctgtgagatccagggctggtgccccacggaggtggacacagtggaaacgcccatcatgatggaagctgagaacttcactattttcatcaagaacagcatccgtttccccctcttcaactttgagaagggaaacctccttcccaacctgacagccagggacatgaagacctgccgcttccacccggacaaggaccctttctgccccatcttgcgggtaggggacgtggtcaagtttgcggggcaggattttgccaaactggcgcgcacggggggagttctgggcattaagatcggctgggtgtgcgacttggacaaggcctgggaccagtgcatccccaaatactccttcacccggctcgacagcgtttctgagaaaagcagcgtgtccccaggctacaacttcaggtttgccaagtactacaaaatggaaaatggcagtgagtaccgcaccctcctgaaggcttttggcatccgcttcgacgtgctggtatacgggaatgctggcaagttcaacatcatccccaccatcatcagctctgtggcggcctttacttctgtgggagtgggaactgttctctgtgacatcatcctgctcaacttcctcaagggggccgaccagtacaaagccaagaagtttgaggaggtgaatgagactacgctgaaaatcgcggctttgaccaacccagtgtaccccagcgaccagaccacagcggagaagcagtccaccgattcgggggccttctccataggccactagggcctctttccagggccccacactcacaaaggctccaggcctccccacagaggaccctgcctgagcaagggggcatgggaaatcgaattcctgctgt

SEQ ID NO: 72589 - DNA, 2022 bp, Homo sapiens
tttttttttgagtcaagtctctatcacccaggctgctggagtgcagtggtgtgatctcgcctcactgcaacctccgcctcctgggttcaagtgattctcgtgcctcagcctcccgagtggctgggattacaggcgcgtgctaccacacctggctaatattttttgtatttttagtagagacagggtttcgccatgttggctaggctggtctctaactcctgacctcaggtgatccgcccaccttggcctcccaaagtgctgggattacaggcataagccaccatgcccagtccctaatatgatcttatttagttgacatttgcctctttccccaaaaatagatcaaaggaaatgtttccctttgtcccgtttcacactaaacgggttggggaggaaccaggggagatgtcaaccgtctgccggtgactgggaagttttctgcaagtcctccacagcatagccagcaggccacttttcactaacagaagtcacaagccaagtgagacactcatccaagaggaaggatggccagtatcttttctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaagcgcagactacccagacctgcgcaacacaacaactgcatggccgagtgcctcacccccgccatttatgccaagcttcgcaacaaggtgacacccaacggctacacgctggaccagtgcatccagactggagtggacaaccctggccaccccttcataaagactgtgggcatggtggctggtgacgaggagtcctatgaggtgtttgctgacctttttgaccccgtcatcaaactaagacacaacggctatgaccccagggtgatgaagcacacaacggatctggatgcatcaaagatcacccaagggcagttcgacgagcattacgtgctgtcttctcgggtgcgcactggccgcagcatccgtgggctgagcctgcctccagcctgcacccgggccgagcgaagggaggtagagaacgtggccatcactgccctggagggcctcaagggggacctggctggccgctactacaagctgtccgagatgacggagcaggaccagcagcggctcatcgatgaccactttctgtttgataagccagtgtcccctttattaacatgtgctgggatggcccgtgactggccagatgccaggggaatctggcataattatgataagacatttctcatctggataaatgaggaggatcacaccagggtaatctcaatggaaaaaggaggcaatatgaaacgagtatttgagcgattctgtcgtggactaaaagaagtagaacggttaatccaagaacgaggctgggagttcatgtggaatgagcgcctaggatacattttgacctgtccttcgaaccttggaacaggactacgagctggtgtccacgttaggatcccaaagctcagcaaggacccacgcttttctaagatcctggaaaacctaagactccagaagcgtggcacaggtggtgtggacactgccgcggtcgcagatgtgtacgacatttccaacatagatagaattggtcgatcagaggttgagcttgttcagatagtcatcgatggagtcaattacctggtggattgtgaaaagaagttggagagaggccaagatattaaggtgccaccccctctgcctcagtttggcaaaaagtaaactttccctttcccaatttataaataatctgtctgctggtacgacagacataaatctctactctgagagtttttatacacttggaaaaatataaaattgtagatcctgcctatctttacaataaaactctccttaatataaaaaaaataattaatctaaaaaaaactcaaggggggcccctgtcccaaattcccctatggaactctttacaattaaatggccgagttttaacacttcag

SEQ ID NO: 72590 - DNA, 1581 bp, Homo sapiens
ccctgcatacacttcttggctgtgtgcgctcagcaggacgtgggaggctccggcttcaaggtgacactcatccaagaggaaggatggccagtatcttttctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaagcgcagactacccagacctgcgcaacacaacaactgcatggccgagtgcctcacccccgccatttatgccaagcttcgcaacaaggtgacacccaacggctacacgctggaccagtgcatccagactggagtggacaaccctggccaccccttcataaagactgtgggcatggtggctggtgacgaggagtcctatgaggtgtttgctgacctttttgaccccgtcatcaaactaagacacaacggctatgaccccagggtgatgaagcacacaacggatctggatgcatcaaagatcacccaagggcagttcgacgagcattacgtgctgtcttctcgggtgcgcactggccgcagcatccgtgggctgagcctgcctccagcctgcacccgggccgagcgaagggaggtagagaacgtggccatcactgccctggagggcctcaagggggacctggctggccgctactacaagctgtccgagatgacggagcaggaccagcagcggctcatcgatgaccactttctgtttgataagccagtgtcccctttattaacatgtgctgggatggcccgtgactggccagatgccaggggaatctggcataattatgataagacatttctcatctggataaatgaggaggatcacaccagggtaatctcaatggaaaaaggaggcaatatgaaacgagtatttgagcgattctgtcgtggactaaaagaagtagaacggttaatccaagaacgaggctgggagttcatgtggaatgagcgcctaggatacattttgacctgtccttcgaaccttggaacaggactacgagctggtgtccacgttaggatcccaaagctcagcaaggacccacgcttttctaagatcctggaaaacctaagactccagaagcgtggcacaggtggtgtggacactgccgcggtcgcagatgtgtacgacatttccaacatagatagaattggtcgatcagaggttgagcttgttcagatagtcatcgatggagtcaattacctggtggattgtgaaaagaagttggagagaggccaagatattaaggtgccaccccctctgcctcagtttggcaaaaagtaaactttccctttcccaatttataaataatctgtctgctggtacgacagacataaatctctactctgagagtttttatacacttggaaaaatataaaattgtagatcctgcctatctttacaataaaactctccttaatataaaaaaaataattaatctaaaaaaaactcaaggggggcccctgtcccaaattcccctatggaactctttacaattaaatggccgagttttaacacttcag

SEQ ID NO: 72591 - DNA, 1524 bp, Homo sapiens
ccctgcatacacttcttggctgtgtgcgctcagcaggacgtgggaggctccggcttcaaggtgacactcatccaagaggaaggatggccagtatcttttctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaagcgcagactacccagacctgcgcaacacaacaactgcatggccgagtgcctcacccccgccatttatgccaagcttcgcaacaaggtgacacccaacggctacacgctggaccagtgcatccagactggagtggacaaccctggccaccccttcataaagactgtgggcatggtggctggtgacgaggagtcctatgaggtgtttgctgacctttttgaccccgtcatcaaactaagacacaacggctatgaccccagggtgatgaagcacacaacggatctggatgcatcaaagatcacccaagggcagttcgacgagcattacgtgctgtcttctcgggtgcgcactggccgcagcatccgtgggctgagcctgcctccagcctgcacccgggccgagcgaagggaggtagagaacgtggccatcactgccctggagggcctcaagggggacctggctggccgctactacaagctgtccgagatgtcccctttattaacatgtgctgggatggcccgtgactggccagatgccaggggaatctggcataattatgataagacatttctcatctggataaatgaggaggatcacaccagggtaatctcaatggaaaaaggaggcaatatgaaacgagtatttgagcgattctgtcgtggactaaaagaagtagaacggttaatccaagaacgaggctgggagttcatgtggaatgagcgcctaggatacattttgacctgtccttcgaaccttggaacaggactacgagctggtgtccacgttaggatcccaaagctcagcaaggacccacgcttttctaagatcctggaaaacctaagactccagaagcgtggcacaggtggtgtggacactgccgcggtcgcagatgtgtacgacatttccaacatagatagaattggtcgatcagaggttgagcttgttcagatagtcatcgatggagtcaattacctggtggattgtgaaaagaagttggagagaggccaagatattaaggtgccaccccctctgcctcagtttggcaaaaagtaaactttccctttcccaatttataaataatctgtctgctggtacgacagacataaatctctactctgagagtttttatacacttggaaaaatataaaattgtagatcctgcctatctttacaataaaactctccttaatataaaaaaaataattaatctaaaaaaaactcaaggggggcccctgtcccaaattcccctatggaactctttacaattaaatggccgagttttaacacttcag

SEQ ID NO: 72592 - DNA, 1226 bp, Homo sapiens
ccctgcatacacttcttggctgtgtgcgctcagcaggacgtgggaggctccggcttcaaggtgacactcatccaagaggaaggatggccagtatcttttctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaagcgcagactacccagacctgcgcaacacaacaactgcatggccgagtgcctcacccccgccatttatgccaagcttcgcaacaaggtgacacccaacggctacacgctggaccagtgcatccagactggagtggacaaccctggccaccccttcataaagactgtgggcatggtggctggtgacgaggagtcctatgaggtgtttgctgacctttttgaccccgtcatcaaactaagacacaacggctatgaccccagggtgatgaagcacacaacggatctggatgcatcaaagatcacccaagggcagttcgacgagcattacgtgctgtcttctcgggtgcgcactggccgcagcatccgtgggctgagcctgcctccagcctgcacccgggccgagcgaagggaggtagagaacgtggccatcactgccctggagggcctcaagggggacctggctggccgctactacaagctgtccgagatgacggagcaggaccagcagcggctcatcgatgaccactttctgtttgataagccagtgtcccctttattaacatgtgctgggatggcccgtgactggccagatgccaggggaatctggcataattatgataagacatttctcatctggataaatgaggaggatcacaccagggtaatctcaatggaaaaaggaggcaatatgaaacgagtatttgagcgattctgtcgtggactaaaagaagtagaacggttaatccaagaacgaggctgggagttcatgtggaatgagcgcctaggatacattttgacctgtccttcgaaccttggaacaggactacgagctggtgtccacgttaggatcccaaagctcagcaaggtactgttatgtgcccagtggccctgatgggccaggatcagctcagatgcgactgctttgtggaggaagaaaacatcactgcccattccttaacccttactttctctatctacaatataaaaataagaaa

SEQ ID NO: 72593 - DNA, 1344 bp, Homo sapiens
ccctgcatacacttcttggctgtgtgcgctcagcaggacgtgggaggctccggcttcaaggtgacactcatccaagaggaaggatggccagtatcttttctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaagcgcagactacccagacctgcgcaacacaacaactgcatggccgagtgcctcacccccgccatttatgccaagcttcgcaacaaggtgacacccaacggctacacgctggaccagtgcatccagactggagtggacaaccctggccaccccttcataaagactgtgggcatggtggctggtgacgaggagtcctatgaggtgtttgctgacctttttgaccccgtcatcaaactaagacacaacggctatgaccccagggtgatgaagcacacaacggatctggatgcatcaaagatcacccaagggcagttcgacgagcattacgtgctgtcttctcgggtgcgcactggccgcagcatccgtgggctgagcctgcctccagcctgcacccgggccgagcgaagggaggtagagaacgtggccatcactgccctggagggcctcaagggggacctggctggccgctactacaagctgtccgagatgacggagcaggaccagcagcggctcatcgatgaccactttctgtttgataagccagtgtcccctttattaacatgtgctgggatggcccgtgactggccagatgccaggggaatctggcataattatgataagacatttctcatctggataaatgaggaggatcacaccagggtaatctcaatggaaaaaggaggcaatatgaaacgagtatttgagcgattctgtcgtggactaaaagaagtagaacggttaatccaagaacgaggctgggagttcatgtggaatgagcgcctaggatacattttgacctgtccttcgaaccttggaacaggactacgagctggtgtccacgttaggatcccaaagctcagcaaggacccacgcttttctaagatcctggaaaacctaagactccagaagcgtggcacaggtggtgtggacactgccgcggtcgcagatgtgtacgacatttccaacatagatagaattggtcgatcagaggtaacgtctctctcactttcctaacatgaactaacaaaatcagcctaagagagaatagagaaaagcaaacagcctagccgttttcacaaaattcgagacctcctcttcgcccattgagtcct

SEQ ID NO: 72594 - DNA, 1160 bp, Homo sapiens
ccctgcatacacttcttggctgtgtgcgctcagcaggacgtgggaggctccggcttcaaggtgacactcatccaagaggaaggatggccagtatcttttctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaagcgcagactacccagacctgcgcaacacaacaactgcatggccgagtgcctcacccccgccatttatgccaagcttcgcaacaaggtgacacccaacggctacacgctggaccagtgcatccagactggagtggacaaccctggccaccccttcataaagactgtgggcatggtggctggtgacgaggagtcctatgaggtgtttgctgacctttttgaccccgtcatcaaactaagacacaacggctatgaccccagggtgatgaagcacacaacggatctggatgcatcaaagatcacccaagggcagttcgacgagcattacgtgctgtcttctcgggtgcgcactggccgcagcatccgtgggctgagcctgcctccagcctgcacccgggccgagcgaagggaggtagagaacgtggccatcactgccctggagggcctcaagggggacctggctggccgctactacaagctgtccgagatgacggagcaggaccagcagcggctcatcgatgaccactttctgtttgataagccagtgtcccctttattaacatgtgctgggatggcccgtgactggccagatgccaggggaatctggcataattatgataagacatttctcatctggataaatgaggaggatcacaccagggtaatctcaatggaaaaaggaggcaatatgaaacgagtatttgagcgattctgtcgtggactaaaagaagtaagatgttatctgagatttctggatatttattaaaataaaattaccgtattgtttgttcttgaaagaagacactatggtaacttccaagatggagctaatttttttctagaaatcaaagcaactgccgcctcccaggttcaagtgattatcccgcctcagcctctagagtagctgggattacaggtgccaccaccac

SEQ ID NO: 72595 - DNA, 1074 bp, Homo sapiens
ccctgcatacacttcttggctgtgtgcgctcagcaggacgtgggaggctccggcttcaaggtgacactcatccaagaggaaggatggccagtatcttttctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaagcgcagactacccagacctgcgcaacacaacaactgcatggccgagtgcctcacccccgccatttatgccaagcttcgcaacaaggtgacacccaacggctacacgctggaccagtgcatccagactggagtggacaaccctggccaccccttcataaagactgtgggcatggtggctggtgacgaggagtcctatgaggtgtttgctgacctttttgaccccgtcatcaaactaagacacaacggctatgaccccagggtgatgaagcacacaacggatctggatgcatcaaagatcacccaagggcagttcgacgagcattacgtgctgtcttctcgggtgcgcactggccgcagcatccgtgggctgagcctgcctccagcctgcacccgggccgagcgaagggaggtagagaacgtggccatcactgccctggagggcctcaagggggacctggctggccgctactacaagctgtccgagatgacggagcaggaccagcagcggctcatcgatgcataattatgataagacatttctcatctggataaatgaggaggatcacaccagggtaatctcaatggaaaaaggaggcaatatgaaacgagtatttgagcgattctgtcgtggactaaaagaagtaagatgttatctgagatttctggatatttattaaaataaaattaccgtattgtttgttcttgaaagaagacactatggtaacttccaagatggagctaatttttttctagaaatcaaagcaactgccgcctcccaggttcaagtgattatcccgcctcagcctctagagtagctgggattacaggtgccaccaccac

SEQ ID NO: 72596 - DNA, 1381 bp, Homo sapiens
cctgggttaaaaccagagttccctatttataatcaagttttctaccagatttataccaagatagagtcctactggcagtgagtgagagacctatctcaccatactctcaccaacactggaagggatcaaaaggataaatagaaaatatgtgttttagttagtagtgactaacattctgattcaaccctctcttggggcctaagtttccttatgcatataaagagatagatagggaggcagctggagtatgtgatgcctgagagctaacattcaatggtcccttccatccttgctgctcattctttagttgtataatgtatgtctggaattaactaatttctctcttaatttgggtttccttgggggcagtacaagtcatttgcttaggaggtgatcccaggggaaaaaaaaattaagtagatgtgctctggtttaaggaaaacaaatatttggaaaccaaagttctatacagagttttttaagaacaggaattttagaaagtatatcttaatttgcaaaactcatttcattaataagcttgcctagcatagtacaaacatgatttagttgccaaacatttgacattaatttttcaggaagacacccactgtattaatgatgatatctgagctacattagcatatccagtgctcagatagattagtggcaggtcagaattcagatccaggccaaagaataacacgagggtgtcactgtagtcttacttctagacaaactctgatattttatagcagacactggtaggaaaaaatgttagagatgcaaactaatggttttcacatagtaaaaaagctttcacatacaaagtagtatccccatcttaactatggaaagattgagagaaacccttatatctctgccttccatttctgagaaggaaggaattgttgtgaagtccatctaagtggcaagttctcatttatcacagtgctgttcctgttaatcaatgccctgcagatgcttctattcaaattaatcattcatcttcttcactgtcaaaggttgagcttgttcagatagtcatcgatggagtcaattacctggtggattgtgaaaagaagttggagagaggccaagatattaaggtgccaccccctctgcctcagtttggcaaaaagtaaactttccctttcccaatttataaataatctgtctgctggtacgacagacataaatctctactctgagagtttttatacacttggaaaaatataaaattgtagatcctgcctatctttacaataaaactctccttaatataaaaaaaataattaatctaaaaaaaactcaaggggggcccctgtcccaaattcccctatggaactctttacaattaaatggccgagttttaacacttcag

SEQ ID NO: 72597 - DNA, 233 bp, Homo sapiens
gtgttgaaacaaatgcaattaacactcagtaccatatttctctcttcattaggcataattatgataagacatttctcatctggataaatgaggaggatcacaccagggtaatctcaatggaaaaaggaggcaatatgaaacgagtatttgagcgattctgtcgtggactaaaagaagtaagatgttatctgagatttctggatatttattaaaataaaattaccgtattgttt

SEQ ID NO: 72598 - DNA, 144 bp, Homo sapiens
gcggccgcctactactactactgctcgaattcaagcttctaacgatgtacggggacatgtgttgtttggggggaattggcaccattttttcctgactatgtttcaattaactaaagaataaatgatgaagaaattctccttgta

SEQ ID NO: 72599 - DNA, 5623 bp, Homo sapiens
  misc_feature (1342)..(1342): n is a, c, g, or t
catccacaattacagcacagggccgcagatcagccagtagacatgatgagcatcaaagcctttacgcttgtctctgctgtggagcgggagctgctgatgggcgacaaggagcgcgtcaacatagagtgcgtggagtgctgcggcagggacctctacgtgggcaccaacgactgcttcgtctaccacttcctgttggaggagaggccagtgcctgctgggccagccacgttcactgccaccaaacagctgcagagacacttgggcttcaagaagcccgtgaacgagctgcgcgcggcctcagcactcaacaggctgctggtgctgtgtgacaactccatcagcctggtcaacatgctgaacctcgagccagtgccttcgggggcccgcatcaagggggcagccacgtttgcactgaacgagaaccctgtgagtggggaccccttctgtgtagaagtttgcatcatctctgtcaaacgcagaaccatccagatgtttctggtgtacgaggaccgggtgcagatcgtcaaggaggtgtcgactgccgagcagcccctcgctgtggctgtggacggccacttcctgtgtctggctctgaccactcagtacatcatccacaattacagcacaggcgtctcccaggacctgtttccctactgcagtgaggagaggccgccgatcgtcaagaggatagggagacaggagttcctgctggcgggccccggagggctgggcatgtttgccacagtcgcagggatatcccagcgcgcccccgtgcactggtcggagaatgtgattggggcggctgtgtcctttccatacgtcatagcgctcgatgacgaattcattcacagtccacagcatgttggatcagcaacagaagcagacgctgccctttaaggagggccatatcctacaggactttgaaggaagagtgatcgttgccacaagtaaaggagtttacatcttggttccattacctttggaaaaacaaatacaggatcttctagcaagccgcagagtagaagaggctttggttttagcaaaaggagcccggaggaacattccaaaggaaaaatttcaggtaatgtacagaaggattctgcagcaggcgggatttatacagtttgcacaacttcagttcctggaagctaaagagctcttcagaagcggccagcttgatgtccgggagctgatctctctctaccccttcctgttgcccacctcctcctccttcacccggtcccaccctcctcttcatgagtacgcagacctgaaccagctgacccagggggaccaggagaagatggccaagtgcaaacgcttcctcatgagctacctgaangaggtccgcagcacagaggtagcaaatggctacaaggaggacatcgacacagccttgctcaaactgtatgcagaggctgaccacgacagcctgctggacctcctggtcactgagaacttctgtcttctgacggacagtgctgcctggctagagaagcacaaaaagtattttgcacttggactgctctatcattataataaccaagatgctgctgcagttcagttgtgggtgaacattgtgaatggcgatgtccaggactccacacgctcagacctgtatgaatacatcgtggattttcttacctactgcttagacgaggaactagtgtgggcctatgctgattgggtcctgcagaaaagtgaagaggtcggagttcaggttttcaccaagagacctttggatgaacagcagaagaacagttttaatccagacgacattatcaattgccttaaaaaataccctaaagcccttgtgaagtatctggaacatcttgtgatagacaagagactgcagaaagaagagtatcacacccacttagctgtgctgtacctggaagaggtgctgctgcagagggcctccgccagtggcaagggtgcagaggccaccgagacgcaggccaagctgcggcggctgctccagaaatctgatttataccgagtccactttcttctcgagaggctgcagggagctggcctgcccatggagagcgccatcctgcacgggaagctgggcgagcatgagaaggcgctgcatatcctggtgcacgagctgcaggactttgcagcggccgaggactactgcctgtggtgctccgagggccgagacccaccccaccgccagcaactctttcacacgctgctggccatctacctgcatgctggccccactgcccacgagctggccgtggctgccgtggacctgctgaaccgccacgccaccgaatttgatgcagcccaggtgctgcagatgctgcctgacacctggtcagtgcagctcctctgcccattcctgatgggggccatgagggacagcatccatgccaggaggaccatgcaggtggctctcggcctggccaggtccgaaaacttaatctacacctacgataagatgaagttgaaaggaagctcaatccaactctcagacaaaaagctttgtcagatatgccaaaatcccttttgtgagcctgtgtttgttagatacccaaatggtggtcttgtgcacacccactgtgccgccagcagacacacaaaccccagctcatccagtcctggcactcggacttgaaaagcttggcccaagggtgcgaggggaactccgagttctttctgagcctgctggacatgaagagcagatgaccaccatgctctgtgtcagccaggacgaagggagacatctgggtgccagggagccttccgtccatacgcaacaaggactcctcgctgctgaccaggctctatgaatgtacatggaaaacccctaaaaatccccaaaacagaaacatacaagagttcacctgtccaggtacatagtaatccaagacagaggtctactttgaaaaaaaaaaaagggagtcttcctcatgcagtccaagacccaggtgggggatcccccaccacccccacactccaacctttagactcatgtttgcactggaaacgtggcttcaccatggctggcgacaaagtcctctcttgcctgggtgagtggcgagggcacagagcctcatgggggtcagccttgccctcctgcagaaacacgttctccatccacgccgctcactcatgggcccatttcccagggttacctcgtgggctctgcctttgccctcagaaacggctgaccctggagaagtacctttgttccttctttcttcctctccggctctcagctcccaaaagattctgccttgtgtacccaagcactcactcttgggtgaactaatgcttctggctgcctagcaagtgaagatctgttgagaaactgagaacgctccaagagagaagctgctctcccctccttgaagaagccgcggacacgggaaacccacggcgggcaagggcccagctgtgtgctcctttcctgtcatggcatctgctgatttgaaactccatgacgaacacgttgaactaaacatttttatttaaatttgtatcatgttcgtagttgctctcttgttgagagagtcatctgtcctgtttgttaggggtattttttcttgttaaaatgtatctcctgttgaatactcgggaaattcaaagggaagtgtggtcagcacacactgagcgttcttttctggagaggccggttttagcctcgtacctttagcaggaccgacagcgggtggaagggcccgtgtgctggatgggggtgtcgcctcctggatggcacaccctcccgaggacatccagacaggctgtgtcaccctccagcactttatgtgcctgctctgaggtgtcctgaacacacagcaacggcctctccttcatcacaggccggggattccttttgtgtttctgtataacatcgatgacgagctgaagctgttgtcacttcactgccctctttggaatttcttcattgtgctgactgattctattaggggctaacaataaaggcagtctacccactactatcatgcttgggaaacaagcgtcagcttgtacatatgacaagagaggaccctgaatacaccctctcttcatcagcccaagccttactgaggtgggatgaagacctcattctctgttctttaaaacatgtttcgtgaactaatattggtccatgtattttttgtccttttgggactctaagtgggtcaagaagcaaaaacatccatgtgttgtttggggggaattggcaccattttttcctgactatgtttcaattaactaaagaataaatgatgaagaaattctccttgtagcacaactgtatgctgtgtaaattggtgtgagctcaaagcccagtcatgtgttttacctgtgggtgactctgttgtagaatggtcatattactgcatatgttatcatgacaacttgtgagtttgagtttatatttctcaaagaacaagttacccgtatatgcaacattgcgccattaaaagcttatttctctgtacacaaaatgggtaaaatcttgaaaaaacttagtaatttctcattcctaacacacagacagagtctcactctgtcacccaggctggagtgcagtggcgcaatctcggctcactgcaacctccacctcctgggttcaagcaattctgctgcctcagcctcccgagtagctgggactacaggtgcatgccaccacgcccagctaatttttgtatttttagtagagacggggtttcaccatgttggccaggatggtctcggtctcctgacctcgtgatctgcctgcctcggcctcccaaagtgctgggattacaggcgtgagccactgcgcccagccaacactagtcatttttattttttcactgaacattgatcaatactctaaaatgtttgtcatcctttagaataatgggaattaaagttgagcagttttccatctctaccaaatccttcaccacaagcagcattctattacagtatgaagaattgtctcatatgttaaaactgtacttttctctaacctttctctcactcctacaaggcccttttctcaaatcatatttctgagagaaatgtatggttctttctcacaggcctgctgatttgtaactgtgccatcgaatagagcaattagatccatcagacctttttcccctcattaggttcagtggaaccattctggttaaaacagcatgaactgaactcagtttacattcatattctatgggcaataccatttggtttttggaactgtttatctgctgttccctatcaagtattaatgtagggatgtcactcaggctgcgttgcactgggctgagttcaactgcgacgctctcactgacgcgtgcttacatgtgcttctcacttccggagcacaggcaggtggctgcggggtcccagctctgaatggatgcccatgatgcaactggggcagcccttgctttttgcttgctctcccacagaaacctttgtccttgcaactttatcctttgtcccgattgggtcccagatacacaaaatgtacaaatgtaaacttgctcattttattaaaattcttttagttctttgttctttctgtaattttttaaaataaaaattgccttgatggagtgatggttttcactcgcaccatacctagtctaaataaagagttctagaatctgta

SEQ ID NO: 72600 - DNA, 5359 bp, Homo sapiens
  misc_feature (1078)..(1078): n is a, c, g, or t
gtagctgggactacagatgtgcaccaccacacctggctaatttttatattttttgtaagggtgaggttttgccatgttgcccaggctagtcttgaactcctgagctcaagcaccatctgcccgcctctgtctcccaacatgttgggattacaggtgtgagccaccacgtccggcctattttattttttattttgctaagtttgtggtaatattattacaacttcatttttaattggaagtaaatatcagatatacattctgggtaaggtagttctcttcacagaaataaattcctgtagggctcttcacacatacagcatattatattgtttttccttccttgaaatataagactgtacaggaaaattgctggtgggcaggggtcggtctgcatccagacatagctacaggaaaatgacaccatgcttatttggaagcctacctaactctttcttcttacttctaggcatgtttgccacagtcgcagggatatcccagcgcgcccccgtgcactggtcggagaatgtgattggggcggctgtgtcctttccatacgtcatagcgctcgatgacgaattcattcacagtccacagcatgttggatcagcaacagaagcagacgctgccctttaaggagggccatatcctacaggactttgaaggaagagtgatcgttgccacaagtaaaggagtttacatcttggttccattacctttggaaaaacaaatacaggatcttctagcaagccgcagagtagaagaggctttggttttagcaaaaggagcccggaggaacattccaaaggaaaaatttcaggtaatgtacagaaggattctgcagcaggcgggatttatacagtttgcacaacttcagttcctggaagctaaagagctcttcagaagcggccagcttgatgtccgggagctgatctctctctaccccttcctgttgcccacctcctcctccttcacccggtcccaccctcctcttcatgagtacgcagacctgaaccagctgacccagggggaccaggagaagatggccaagtgcaaacgcttcctcatgagctacctgaangaggtccgcagcacagaggtagcaaatggctacaaggaggacatcgacacagccttgctcaaactgtatgcagaggctgaccacgacagcctgctggacctcctggtcactgagaacttctgtcttctgacggacagtgctgcctggctagagaagcacaaaaagtattttgcacttggactgctctatcattataataaccaagatgctgctgcagttcagttgtgggtgaacattgtgaatggcgatgtccaggactccacacgctcagacctgtatgaatacatcgtggattttcttacctactgcttagacgaggaactagtgtgggcctatgctgattgggtcctgcagaaaagtgaagaggtcggagttcaggttttcaccaagagacctttggatgaacagcagaagaacagttttaatccagacgacattatcaattgccttaaaaaataccctaaagcccttgtgaagtatctggaacatcttgtgatagacaagagactgcagaaagaagagtatcacacccacttagctgtgctgtacctggaagaggtgctgctgcagagggcctccgccagtggcaagggtgcagaggccaccgagacgcaggccaagctgcggcggctgctccagaaatctgatttataccgagtccactttcttctcgagaggctgcagggagctggcctgcccatggagagcgccatcctgcacgggaagctgggcgagcatgagaaggcgctgcatatcctggtgcacgagctgcaggactttgcagcggccgaggactactgcctgtggtgctccgagggccgagacccaccccaccgccagcaactctttcacacgctgctggccatctacctgcatgctggccccactgcccacgagctggccgtggctgccgtggacctgctgaaccgccacgccaccgaatttgatgcagcccaggtgctgcagatgctgcctgacacctggtcagtgcagctcctctgcccattcctgatgggggccatgagggacagcatccatgccaggaggaccatgcaggtggctctcggcctggccaggtccgaaaacttaatctacacctacgataagatgaagttgaaaggaagctcaatccaactctcagacaaaaagctttgtcagatatgccaaaatcccttttgtgagcctgtgtttgttagatacccaaatggtggtcttgtgcacacccactgtgccgccagcagacacacaaaccccagctcatccagtcctggcactcggacttgaaaagcttggcccaagggtgcgaggggaactccgagttctttctgagcctgctggacatgaagagcagatgaccaccatgctctgtgtcagccaggacgaagggagacatctgggtgccagggagccttccgtccatacgcaacaaggactcctcgctgctgaccaggctctatgaatgtacatggaaaacccctaaaaatccccaaaacagaaacatacaagagttcacctgtccaggtacatagtaatccaagacagaggtctactttgaaaaaaaaaaaagggagtcttcctcatgcagtccaagacccaggtgggggatcccccaccacccccacactccaacctttagactcatgtttgcactggaaacgtggcttcaccatggctggcgacaaagtcctctcttgcctgggtgagtggcgagggcacagagcctcatgggggtcagccttgccctcctgcagaaacacgttctccatccacgccgctcactcatgggcccatttcccagggttacctcgtgggctctgcctttgccctcagaaacggctgaccctggagaagtacctttgttccttctttcttcctctccggctctcagctcccaaaagattctgccttgtgtacccaagcactcactcttgggtgaactaatgcttctggctgcctagcaagtgaagatctgttgagaaactgagaacgctccaagagagaagctgctctcccctccttgaagaagccgcggacacgggaaacccacggcgggcaagggcccagctgtgtgctcctttcctgtcatggcatctgctgatttgaaactccatgacgaacacgttgaactaaacatttttatttaaatttgtatcatgttcgtagttgctctcttgttgagagagtcatctgtcctgtttgttaggggtattttttcttgttaaaatgtatctcctgttgaatactcgggaaattcaaagggaagtgtggtcagcacacactgagcgttcttttctggagaggccggttttagcctcgtacctttagcaggaccgacagcgggtggaagggcccgtgtgctggatgggggtgtcgcctcctggatggcacaccctcccgaggacatccagacaggctgtgtcaccctccagcactttatgtgcctgctctgaggtgtcctgaacacacagcaacggcctctccttcatcacaggccggggattccttttgtgtttctgtataacatcgatgacgagctgaagctgttgtcacttcactgccctctttggaatttcttcattgtgctgactgattctattaggggctaacaataaaggcagtctacccactactatcatgcttgggaaacaagcgtcagcttgtacatatgacaagagaggaccctgaatacaccctctcttcatcagcccaagccttactgaggtgggatgaagacctcattctctgttctttaaaacatgtttcgtgaactaatattggtccatgtattttttgtccttttgggactctaagtgggtcaagaagcaaaaacatccatgtgttgtttggggggaattggcaccattttttcctgactatgtttcaattaactaaagaataaatgatgaagaaattctccttgtagcacaactgtatgctgtgtaaattggtgtgagctcaaagcccagtcatgtgttttacctgtgggtgactctgttgtagaatggtcatattactgcatatgttatcatgacaacttgtgagtttgagtttatatttctcaaagaacaagttacccgtatatgcaacattgcgccattaaaagcttatttctctgtacacaaaatgggtaaaatcttgaaaaaacttagtaatttctcattcctaacacacagacagagtctcactctgtcacccaggctggagtgcagtggcgcaatctcggctcactgcaacctccacctcctgggttcaagcaattctgctgcctcagcctcccgagtagctgggactacaggtgcatgccaccacgcccagctaatttttgtatttttagtagagacggggtttcaccatgttggccaggatggtctcggtctcctgacctcgtgatctgcctgcctcggcctcccaaagtgctgggattacaggcgtgagccactgcgcccagccaacactagtcatttttattttttcactgaacattgatcaatactctaaaatgtttgtcatcctttagaataatgggaattaaagttgagcagttttccatctctaccaaatccttcaccacaagcagcattctattacagtatgaagaattgtctcatatgttaaaactgtacttttctctaacctttctctcactcctacaaggcccttttctcaaatcatatttctgagagaaatgtatggttctttctcacaggcctgctgatttgtaactgtgccatcgaatagagcaattagatccatcagacctttttcccctcattaggttcagtggaaccattctggttaaaacagcatgaactgaactcagtttacattcatattctatgggcaataccatttggtttttggaactgtttatctgctgttccctatcaagtattaatgtagggatgtcactcaggctgcgttgcactgggctgagttcaactgcgacgctctcactgacgcgtgcttacatgtgcttctcacttccggagcacaggcaggtggctgcggggtcccagctctgaatggatgcccatgatgcaactggggcagcccttgctttttgcttgctctcccacagaaacctttgtccttgcaactttatcctttgtcccgattgggtcccagatacacaaaatgtacaaatgtaaacttgctcattttattaaaattcttttagttctttgttctttctgtaattttttaaaataaaaattgccttgatggagtgatggttttcactcgcaccatacctagtctaaataaagagttctagaatctgta

SEQ ID NO: 72601 - DNA, 4264 bp, Homo sapiens
  misc_feature (1342)..(1342): n is a, c, g, or t
catccacaattacagcacagggccgcagatcagccagtagacatgatgagcatcaaagcctttacgcttgtctctgctgtggagcgggagctgctgatgggcgacaaggagcgcgtcaacatagagtgcgtggagtgctgcggcagggacctctacgtgggcaccaacgactgcttcgtctaccacttcctgttggaggagaggccagtgcctgctgggccagccacgttcactgccaccaaacagctgcagagacacttgggcttcaagaagcccgtgaacgagctgcgcgcggcctcagcactcaacaggctgctggtgctgtgtgacaactccatcagcctggtcaacatgctgaacctcgagccagtgccttcgggggcccgcatcaagggggcagccacgtttgcactgaacgagaaccctgtgagtggggaccccttctgtgtagaagtttgcatcatctctgtcaaacgcagaaccatccagatgtttctggtgtacgaggaccgggtgcagatcgtcaaggaggtgtcgactgccgagcagcccctcgctgtggctgtggacggccacttcctgtgtctggctctgaccactcagtacatcatccacaattacagcacaggcgtctcccaggacctgtttccctactgcagtgaggagaggccgccgatcgtcaagaggatagggagacaggagttcctgctggcgggccccggagggctgggcatgtttgccacagtcgcagggatatcccagcgcgcccccgtgcactggtcggagaatgtgattggggcggctgtgtcctttccatacgtcatagcgctcgatgacgaattcattcacagtccacagcatgttggatcagcaacagaagcagacgctgccctttaaggagggccatatcctacaggactttgaaggaagagtgatcgttgccacaagtaaaggagtttacatcttggttccattacctttggaaaaacaaatacaggatcttctagcaagccgcagagtagaagaggctttggttttagcaaaaggagcccggaggaacattccaaaggaaaaatttcaggtaatgtacagaaggattctgcagcaggcgggatttatacagtttgcacaacttcagttcctggaagctaaagagctcttcagaagcggccagcttgatgtccgggagctgatctctctctaccccttcctgttgcccacctcctcctccttcacccggtcccaccctcctcttcatgagtacgcagacctgaaccagctgacccagggggaccaggagaagatggccaagtgcaaacgcttcctcatgagctacctgaangaggtccgcagcacagaggtagcaaatggctacaaggaggacatcgacacagccttgctcaaactgtatgcagaggctgaccacgacagcctgctggacctcctggtcactgagaacttctgtcttctgacggacagtgctgcctggctagagaagcacaaaaagtattttgcacttggactgctctatcattataataaccaagatgctgctgcagttcagttgtgggtgaacattgtgaatggcgatgtccaggactccacacgctcagacctgtatgaatacatcgtggattttcttacctactgcttagacgaggaactagtgtgggcctatgctgattgggtcctgcagaaaagtgaagaggtcggagttcaggttttcaccaagagacctttggatgaacagcagaagaacagttttaatccagacgacattatcaattgccttaaaaaataccctaaagcccttgtgaagtatctggaacatcttgtgatagacaagagactgcagaaagaagagtatcacacccacttagctgtgctgtacctggaagaggtgctgctgcagagggcctccgccagtggcaagggtgcagaggccaccgagacgcaggccaagctgcggcggctgctccagaaatctgatttataccgagtccactttcttctcgagaggctgcagggagctggcctgcccatggagagcgccatcctgcacgggaagctgggcgagcatgagaaggcgctgcatatcctggtgcacgagctgcaggactttgcagcggccgaggactactgcctgtggtgctccgagggccgagacccaccccaccgccagcaactctttcacacgctgctggccatctacctgcatgctggccccactgcccacgagctggccgtggctgccgtggacctgctgaaccgccacgccaccgaatttgatgcagcccaggtgctgcagatgctgcctgacacctggtcagtgcagctcctctgcccattcctgatgggggccatgagggacagcatccatgccaggaggaccatgcaggtggctctcggcctggccaggtccgaaaacttaatctacacctacgataagatgaagttgaaaggaagctcaatccaactctcagacaaaaagctttgtcagatatgccaaaatcccttttgtgagcctgtgtttgttagatacccaaatggtggtcttgtgcacacccactgtgccgccagcagacacacaaaccccagctcatccagtcctggcactcggacttgaaaagcttggcccaagggtgcgaggggaactccgagttctttctgagcctgctggacatgaagagcagatgaccaccatgctctgtgtcagccaggacgaagggagacatctgggtgccagggagccttccgtccatacgcaacaaggactcctcgctgctgaccaggctctatgaatgtacatggaaaacccctaaaaatccccaaaacagaaacatacaagagttcacctgtccaggtacatagtaatccaagacagaggtctactttgaaaaaaaaaaaagggagtcttcctcatgcagtccaagacccaggtgggggatcccccaccacccccacactccaacctttagactcatgtttgcactggaaacgtggcttcaccatggctggcgacaaagtcctctcttgcctgggtgagtggcgagggcacagagcctcatgggggtcagccttgccctcctgcagaaacacgttctccatccacgccgctcactcatgggcccatttcccagggttacctcgtgggctctgcctttgccctcagaaacggctgaccctggagaagtacctttgttccttctttcttcctctccggctctcagctcccaaaagattctgccttgtgtacccaagcactcactcttgggtgaactaatgcttctggctgcctagcaagtgaagatctgttgagaaactgagaacgctccaagagagaagctgctctcccctccttgaagaagccgcggacacgggaaacccacggcgggcaagggcccagctgtgtgctcctttcctgtcatggcatctgctgatttgaaactccatgacgaacacgttgaactaaacatttttatttaaatttgtatcatgttcgtagttgctctcttgttgagagagtcatctgtcctgtttgttaggggtattttttcttgttaaaatgtatctcctgttgaatactcgggaaattcaaagggaagtgtggtcagcacacactgagcgttcttttctggagaggccggttttagcctcgtacctttagcaggaccgacagcgggtggaagggcccgtgtgctggatgggggtgtcgcctcctggatggcacaccctcccgaggacatccagacaggctgtgtcaccctccagcactttatgtgcctgctctgaggtgtcctgaacacacagcaacggcctctccttcatcacaggccggggattccttttgtgtttctgtataacatcgatgacgagctgaagctgttgtcacttcactgccctctttggaatttcttcattgtgctgactgattctattaggggctaacaataaaggcagtctacccactactatcatgcttgggaaacaagcgtcagcttgtacatatgacaagagaggaccctgaatacaccctctcttcatcagcccaagccttactgaggtgggatgaagacctcattctctgttctttaaaacatgtttcgtgaactaatattggtccatgtattttttgtccttttgggactctaagtgggtcaagaagcaaaaacatccatgtgttgtttggggggaattggcaccattttttcctgactatgtttcaattaactaaagaataaatgatgaagaaattctccttgta

SEQ ID NO: 72602 - DNA, 5707 bp, Homo sapiens
  misc_feature (1398)..(1398): n is a, c, g, or t
ccagcccaggagccgcgggccggagcggggcggcggggccccaggccgcggggcggcgcgggacggcgggcgccggcgccgcagatcagccagtagacatgatgagcatcaaagcctttacgcttgtctctgctgtggagcgggagctgctgatgggcgacaaggagcgcgtcaacatagagtgcgtggagtgctgcggcagggacctctacgtgggcaccaacgactgcttcgtctaccacttcctgttggaggagaggccagtgcctgctgggccagccacgttcactgccaccaaacagctgcagagacacttgggcttcaagaagcccgtgaacgagctgcgcgcggcctcagcactcaacaggctgctggtgctgtgtgacaactccatcagcctggtcaacatgctgaacctcgagccagtgccttcgggggcccgcatcaagggggcagccacgtttgcactgaacgagaaccctgtgagtggggaccccttctgtgtagaagtttgcatcatctctgtcaaacgcagaaccatccagatgtttctggtgtacgaggaccgggtgcagatcgtcaaggaggtgtcgactgccgagcagcccctcgctgtggctgtggacggccacttcctgtgtctggctctgaccactcagtacatcatccacaattacagcacaggcgtctcccaggacctgtttccctactgcagtgaggagaggccgccgatcgtcaagaggatagggagacaggagttcctgctggcgggccccggagggctgggcatgtttgccacagtcgcagggatatcccagcgcgcccccgtgcactggtcggagaatgtgattggggcggctgtgtcctttccatacgtcatagcgctcgatgacgaattcattcacagtccacagcatgttggatcagcaacagaagcagacgctgccctttaaggagggccatatcctacaggactttgaaggaagagtgatcgttgccacaagtaaaggagtttacatcttggttccattacctttggaaaaacaaatacaggatcttctagcaagccgcagagtagaagaggctttggttttagcaaaaggagcccggaggaacattccaaaggaaaaatttcaggtaatgtacagaaggattctgcagcaggcgggatttatacagtttgcacaacttcagttcctggaagctaaagagctcttcagaagcggccagcttgatgtccgggagctgatctctctctaccccttcctgttgcccacctcctcctccttcacccggtcccaccctcctcttcatgagtacgcagacctgaaccagctgacccagggggaccaggagaagatggccaagtgcaaacgcttcctcatgagctacctgaangaggtccgcagcacagaggtagcaaatggctacaaggaggacatcgacacagccttgctcaaactgtatgcagaggctgaccacgacagcctgctggacctcctggtcactgagaacttctgtcttctgacggacagtgctgcctggctagagaagcacaaaaagtattttgcacttggactgctctatcattataataaccaagatgctgctgcagttcagttgtgggtgaacattgtgaatggcgatgtccaggactccacacgctcagacctgtatgaatacatcgtggattttcttacctactgcttagacgaggaactagtgtgggcctatgctgattgggtcctgcagaaaagtgaagaggtcggagttcaggttttcaccaagagacctttggatgaacagcagaagaacagttttaatccagacgacattatcaattgccttaaaaaataccctaaagcccttgtgaagtatctggaacatcttgtgatagacaagagactgcagaaagaagagtatcacacccacttagctgtgctgtacctggaagaggtgctgctgcagagggcctccgccagtggcaagggtgcagaggccaccgagacgcaggccaagctgcggcggctgctccagaaatctgatttataccgagtccactttcttctcgagaggctgcagggagctggcctgcccatggagagcgccatcctgcacgggaagctgggcgagcatgagaaggcgctgcatatcctggtgcacgagctgcaggactttgcagcggccgaggactactgcctgtggtgctccgagggccgagacccaccccaccgccagcaactctttcacacgctgctggccatctacctgcatgctggccccactgcccacgagctggccgtggctgccgtggacctgctgaaccgccacgccaccgaatttgatgcagcccaggtgctgcagatgctgcctgacacctggtcagtgcagctcctctgcccattcctgatgggggccatgagggacagcatccatgccaggaggaccatgcaggtggctctcggcctggccaggtccgaaaacttaatctacacctacgataagatgaagttgaaaggaagctcaatccaactctcagacaaaaagctttgtcagatatgccaaaatcccttttgtgagcctgtgtttgttagatacccaaatggtggtcttgtgcacacccactgtgccgccagcagacacacaaaccccagctcatccagtcctggcactcggacttgaaaagcttggcccaagggtgcgaggggaactccgagttctttctgagcctgctggacatgaagagcagatgaccaccatgctctgtgtcagccaggacgaagggagacatctgggtgccagggagccttccgtccatacgcaacaaggactcctcgctgctgaccaggctctatgaatgtacatggaatgaccaggctctatgaatgtacatggaaaacccctaaaaatccccaaaacagaaacatacaagagttcacctgtccaggtacatagtaatccaagacagaggtctactttgaaaaaaaaaaaagggagtcttcctcatgcagtccaagacccaggtgggggatcccccaccacccccacactccaacctttagactcatgtttgcactggaaacgtggcttcaccatggctggcgacaaagtcctctcttgcctgggtgagtggcgagggcacagagcctcatgggggtcagccttgccctcctgcagaaacacgttctccatccacgccgctcactcatgggcccatttcccagggttacctcgtgggctctgcctttgccctcagaaacggctgaccctggagaagtacctttgttccttctttcttcctctccggctctcagctcccaaaagattctgccttgtgtacccaagcactcactcttgggtgaactaatgcttctggctgcctagcaagtgaagatctgttgagaaactgagaacgctccaagagagaagctgctctcccctccttgaagaagccgcggacacgggaaacccacggcgggcaagggcccagctgtgtgctcctttcctgtcatggcatctgctgatttgaaactccatgacgaacacgttgaactaaacatttttatttaaatttgtatcatgttcgtagttgctctcttgttgagagagtcatctgtcctgtttgttaggggtattttttcttgttaaaatgtatctcctgttgaatactcgggaaattcaaagggaagtgtggtcagcacacactgagcgttcttttctggagaggccggttttagcctcgtacctttagcaggaccgacagcgggtggaagggcccgtgtgctggatgggggtgtcgcctcctggatggcacaccctcccgaggacatccagacaggctgtgtcaccctccagcactttatgtgcctgctctgaggtgtcctgaacacacagcaacggcctctccttcatcacaggccggggattccttttgtgtttctgtataacatcgatgacgagctgaagctgttgtcacttcactgccctctttggaatttcttcattgtgctgactgattctattaggggctaacaataaaggcagtctacccactactatcatgcttgggaaacaagcgtcagcttgtacatatgacaagagaggaccctgaatacaccctctcttcatcagcccaagccttactgaggtgggatgaagacctcattctctgttctttaaaacatgtttcgtgaactaatattggtccatgtattttttgtccttttgggactctaagtgggtcaagaagcaaaaacatccatgtgttgtttggggggaattggcaccattttttcctgactatgtttcaattaactaaagaataaatgatgaagaaattctccttgtagcacaactgtatgctgtgtaaattggtgtgagctcaaagcccagtcatgtgttttacctgtgggtgactctgttgtagaatggtcatattactgcatatgttatcatgacaacttgtgagtttgagtttatatttctcaaagaacaagttacccgtatatgcaacattgcgccattaaaagcttatttctctgtacacaaaatgggtaaaatcttgaaaaaacttagtaatttctcattcctaacacacagacagagtctcactctgtcacccaggctggagtgcagtggcgcaatctcggctcactgcaacctccacctcctgggttcaagcaattctgctgcctcagcctcccgagtagctgggactacaggtgcatgccaccacgcccagctaatttttgtatttttagtagagacggggtttcaccatgttggccaggatggtctcggtctcctgacctcgtgatctgcctgcctcggcctcccaaagtgctgggattacaggcgtgagccactgcgcccagccaacactagtcatttttattttttcactgaacattgatcaatactctaaaatgtttgtcatcctttagaataatgggaattaaagttgagcagttttccatctctaccaaatccttcaccacaagcagcattctattacagtatgaagaattgtctcatatgttaaaactgtacttttctctaacctttctctcactcctacaaggcccttttctcaaatcatatttctgagagaaatgtatggttctttctcacaggcctgctgatttgtaactgtgccatcgaatagagcaattagatccatcagacctttttcccctcattaggttcagtggaaccattctggttaaaacagcatgaactgaactcagtttacattcatattctatgggcaataccatttggtttttggaactgtttatctgctgttccctatcaagtattaatgtagggatgtcactcaggctgcgttgcactgggctgagttcaactgcgacgctctcactgacgcgtgcttacatgtgcttctcacttccggagcacaggcaggtggctgcggggtcccagctctgaatggatgcccatgatgcaactggggcagcccttgctttttgcttgctctcccacagaaacctttgtccttgcaactttatcctttgtcccgattgggtcccagatacacaaaatgtacaaatgtaaacttgctcattttattaaaattcttttagttctttgttctttctgtaattttttaaaataaaaattgccttgatggagtgatggttttcactcgcaccatacctagtctaaataaagagttctagaatctgta

SEQ ID NO: 72603 - DNA, 827 bp, Homo sapiens
ccagcccaggagccgcgggccggagcggggcggcggggccccaggccgcggggcggcgcgggacggcgggcgccggcgccgcagatcagccagtagacatgatgagcatcaaagcctttacgcttgtctctgctgtggagcgggagctgctgatgggcgacaaggagcgcgtcaacatagagtgcgtggagtgctgcggcagggacctctacgtgggcaccaacgactgcttcgtctaccacttcctgttggaggagaggccagtgcctgctgggccagccacgttcactgccaccaaacagctgcagagacacttgggcttcaagaagcccgtgaacgagctgcgcgcggcctcagcactcaacaggctgctggtgctgtgtgacaactccatcagcctggtcaacatgctgaacctcgagccagtgccttcgggggcccgcatcaagggggcagccacgtttgcactgaacgagaaccctgtgagtggggaccccttctgtgtagaagtttgcatcatctctgtcaaacgcagaaccatccagatgtttctggtgtacgaggaccgggtgcagatcgtcaaggaggtgtcgactgccgagcagcccctcgctgtggctgtggacggccacttcctgtgtctggctctgaccactcagtacatcatccacaattacagcacaggcgtctcccaggacctgtttccctactgcagtgaggagaggccgccgatcgtcaagaggatagggagacaggagttcctgctggcgggccccggagggctgggtgaggaggatgcatttgtgcgcctgatctttttgggtggc

SEQ ID NO: 72604 - DNA, 5679 bp, Homo sapiens
  misc_feature (1398)..(1398): n is a, c, g, or t
ccagcccaggagccgcgggccggagcggggcggcggggccccaggccgcggggcggcgcgggacggcgggcgccggcgccgcagatcagccagtagacatgatgagcatcaaagcctttacgcttgtctctgctgtggagcgggagctgctgatgggcgacaaggagcgcgtcaacatagagtgcgtggagtgctgcggcagggacctctacgtgggcaccaacgactgcttcgtctaccacttcctgttggaggagaggccagtgcctgctgggccagccacgttcactgccaccaaacagctgcagagacacttgggcttcaagaagcccgtgaacgagctgcgcgcggcctcagcactcaacaggctgctggtgctgtgtgacaactccatcagcctggtcaacatgctgaacctcgagccagtgccttcgggggcccgcatcaagggggcagccacgtttgcactgaacgagaaccctgtgagtggggaccccttctgtgtagaagtttgcatcatctctgtcaaacgcagaaccatccagatgtttctggtgtacgaggaccgggtgcagatcgtcaaggaggtgtcgactgccgagcagcccctcgctgtggctgtggacggccacttcctgtgtctggctctgaccactcagtacatcatccacaattacagcacaggcgtctcccaggacctgtttccctactgcagtgaggagaggccgccgatcgtcaagaggatagggagacaggagttcctgctggcgggccccggagggctgggcatgtttgccacagtcgcagggatatcccagcgcgcccccgtgcactggtcggagaatgtgattggggcggctgtgtcctttccatacgtcatagcgctcgatgacgaattcattcacagtccacagcatgttggatcagcaacagaagcagacgctgccctttaaggagggccatatcctacaggactttgaaggaagagtgatcgttgccacaagtaaaggagtttacatcttggttccattacctttggaaaaacaaatacaggatcttctagcaagccgcagagtagaagaggctttggttttagcaaaaggagcccggaggaacattccaaaggaaaaatttcaggtaatgtacagaaggattctgcagcaggcgggatttatacagtttgcacaacttcagttcctggaagctaaagagctcttcagaagcggccagcttgatgtccgggagctgatctctctctaccccttcctgttgcccacctcctcctccttcacccggtcccaccctcctcttcatgagtacgcagacctgaaccagctgacccagggggaccaggagaagatggccaagtgcaaacgcttcctcatgagctacctgaangaggtccgcagcacagaggtagcaaatggctacaaggaggacatcgacacagccttgctcaaactgtatgcagaggctgaccacgacagcctgctggacctcctggtcactgagaacttctgtcttctgacggacagtgctgcctggctagagaagcacaaaaagtattttgcacttggactgctctatcattataataaccaagatgctgctgcagttcagttgtgggtgaacattgtgaatggcgatgtccaggactccacacgctcagacctgtatgaatacatcgtggattttcttacctactgcttagacgaggaactagtgtgggcctatgctgattgggtcctgcagaaaagtgaagaggtcggagttcaggttttcaccaagagacctttggatgaacagcagaagaacagttttaatccagacgacattatcaattgccttaaaaaataccctaaagcccttgtgaagtatctggaacatcttgtgatagacaagagactgcagaaagaagagtatcacacccacttagctgtgctgtacctggaagaggtgctgctgcagagggcctccgccagtggcaagggtgcagaggccaccgagacgcaggccaagctgcggcggctgctccagaaatctgatttataccgagtccactttcttctcgagaggctgcagggagctggcctgcccatggagagcgccatcctgcacgggaagctgggcgagcatgagaaggcgctgcatatcctggtgcacgagctgcaggactttgcagcggccgaggactactgcctgtggtgctccgagggccgagacccaccccaccgccagcaactctttcacacgctgctggccatctacctgcatgctggccccactgcccacgagctggccgtggctgccgtggacctgctgaaccgccacgccaccgaatttgatgcagcccaggtgctgcagatgctgcctgacacctggtcagtgcagctcctctgcccattcctgatgggggccatgagggacagcatccatgccaggaggaccatgcaggtggctctcggcctggccaggtccgaaaacttaatctacacctacgataagatgaagttgaaaggaagctcaatccaactctcagacaaaaagctttgtcagatatgccaaaatcccttttgtgagcctgtgtttgttagatacccaaatggtggtcttgtgcacacccactgtgccgccagcagacacacaaaccccagctcatccagtcctggcactcggacttgaaaagcttggcccaagggtgcgaggggaactccgagttctttctgagcctgctggacatgaagagcagatgaccaccatgctctgtgtcagccaggacgaagggagacatctgggtgccagggagccttccgtccatacgcaacaaggactcctcgctgctgaccaggctctatgaatgtacatggaaaacccctaaaaatccccaaaacagaaacatacaagagttcacctgtccaggtacatagtaatccaagacagaggtctactttgaaaaaaaaaaaagggagtcttcctcatgcagtccaagacccaggtgggggatcccccaccacccccacactccaacctttagactcatgtttgcactggaaacgtggcttcaccatggctggcgacaaagtcctctcttgcctgggtgagtggcgagggcacagagcctcatgggggtcagccttgccctcctgcagaaacacgttctccatccacgccgctcactcatgggcccatttcccagggttacctcgtgggctctgcctttgccctcagaaacggctgaccctggagaagtacctttgttccttctttcttcctctccggctctcagctcccaaaagattctgccttgtgtacccaagcactcactcttgggtgaactaatgcttctggctgcctagcaagtgaagatctgttgagaaactgagaacgctccaagagagaagctgctctcccctccttgaagaagccgcggacacgggaaacccacggcgggcaagggcccagctgtgtgctcctttcctgtcatggcatctgctgatttgaaactccatgacgaacacgttgaactaaacatttttatttaaatttgtatcatgttcgtagttgctctcttgttgagagagtcatctgtcctgtttgttaggggtattttttcttgttaaaatgtatctcctgttgaatactcgggaaattcaaagggaagtgtggtcagcacacactgagcgttcttttctggagaggccggttttagcctcgtacctttagcaggaccgacagcgggtggaagggcccgtgtgctggatgggggtgtcgcctcctggatggcacaccctcccgaggacatccagacaggctgtgtcaccctccagcactttatgtgcctgctctgaggtgtcctgaacacacagcaacggcctctccttcatcacaggccggggattccttttgtgtttctgtataacatcgatgacgagctgaagctgttgtcacttcactgccctctttggaatttcttcattgtgctgactgattctattaggggctaacaataaaggcagtctacccactactatcatgcttgggaaacaagcgtcagcttgtacatatgacaagagaggaccctgaatacaccctctcttcatcagcccaagccttactgaggtgggatgaagacctcattctctgttctttaaaacatgtttcgtgaactaatattggtccatgtattttttgtccttttgggactctaagtgggtcaagaagcaaaaacatccatgtgttgtttggggggaattggcaccattttttcctgactatgtttcaattaactaaagaataaatgatgaagaaattctccttgtagcacaactgtatgctgtgtaaattggtgtgagctcaaagcccagtcatgtgttttacctgtgggtgactctgttgtagaatggtcatattactgcatatgttatcatgacaacttgtgagtttgagtttatatttctcaaagaacaagttacccgtatatgcaacattgcgccattaaaagcttatttctctgtacacaaaatgggtaaaatcttgaaaaaacttagtaatttctcattcctaacacacagacagagtctcactctgtcacccaggctggagtgcagtggcgcaatctcggctcactgcaacctccacctcctgggttcaagcaattctgctgcctcagcctcccgagtagctgggactacaggtgcatgccaccacgcccagctaatttttgtatttttagtagagacggggtttcaccatgttggccaggatggtctcggtctcctgacctcgtgatctgcctgcctcggcctcccaaagtgctgggattacaggcgtgagccactgcgcccagccaacactagtcatttttattttttcactgaacattgatcaatactctaaaatgtttgtcatcctttagaataatgggaattaaagttgagcagttttccatctctaccaaatccttcaccacaagcagcattctattacagtatgaagaattgtctcatatgttaaaactgtacttttctctaacctttctctcactcctacaaggcccttttctcaaatcatatttctgagagaaatgtatggttctttctcacaggcctgctgatttgtaactgtgccatcgaatagagcaattagatccatcagacctttttcccctcattaggttcagtggaaccattctggttaaaacagcatgaactgaactcagtttacattcatattctatgggcaataccatttggtttttggaactgtttatctgctgttccctatcaagtattaatgtagggatgtcactcaggctgcgttgcactgggctgagttcaactgcgacgctctcactgacgcgtgcttacatgtgcttctcacttccggagcacaggcaggtggctgcggggtcccagctctgaatggatgcccatgatgcaactggggcagcccttgctttttgcttgctctcccacagaaacctttgtccttgcaactttatcctttgtcccgattgggtcccagatacacaaaatgtacaaatgtaaacttgctcattttattaaaattcttttagttctttgttctttctgtaattttttaaaataaaaattgccttgatggagtgatggttttcactcgcaccatacctagtctaaataaagagttctagaatctgta

SEQ ID NO: 72605 - DNA, 4526 bp, Homo sapiens
  misc_feature (1342)..(1342): n is a, c, g, or t
catccacaattacagcacagggccgcagatcagccagtagacatgatgagcatcaaagcctttacgcttgtctctgctgtggagcgggagctgctgatgggcgacaaggagcgcgtcaacatagagtgcgtggagtgctgcggcagggacctctacgtgggcaccaacgactgcttcgtctaccacttcctgttggaggagaggccagtgcctgctgggccagccacgttcactgccaccaaacagctgcagagacacttgggcttcaagaagcccgtgaacgagctgcgcgcggcctcagcactcaacaggctgctggtgctgtgtgacaactccatcagcctggtcaacatgctgaacctcgagccagtgccttcgggggcccgcatcaagggggcagccacgtttgcactgaacgagaaccctgtgagtggggaccccttctgtgtagaagtttgcatcatctctgtcaaacgcagaaccatccagatgtttctggtgtacgaggaccgggtgcagatcgtcaaggaggtgtcgactgccgagcagcccctcgctgtggctgtggacggccacttcctgtgtctggctctgaccactcagtacatcatccacaattacagcacaggcgtctcccaggacctgtttccctactgcagtgaggagaggccgccgatcgtcaagaggatagggagacaggagttcctgctggcgggccccggagggctgggcatgtttgccacagtcgcagggatatcccagcgcgcccccgtgcactggtcggagaatgtgattggggcggctgtgtcctttccatacgtcatagcgctcgatgacgaattcattcacagtccacagcatgttggatcagcaacagaagcagacgctgccctttaaggagggccatatcctacaggactttgaaggaagagtgatcgttgccacaagtaaaggagtttacatcttggttccattacctttggaaaaacaaatacaggatcttctagcaagccgcagagtagaagaggctttggttttagcaaaaggagcccggaggaacattccaaaggaaaaatttcaggtaatgtacagaaggattctgcagcaggcgggatttatacagtttgcacaacttcagttcctggaagctaaagagctcttcagaagcggccagcttgatgtccgggagctgatctctctctaccccttcctgttgcccacctcctcctccttcacccggtcccaccctcctcttcatgagtacgcagacctgaaccagctgacccagggggaccaggagaagatggccaagtgcaaacgcttcctcatgagctacctgaangaggtccgcagcacagaggtagcaaatggctacaaggaggacatcgacacagccttgctcaaactgtatgcagaggctgaccacgacagcctgctggacctcctggtcactgagaacttctgtcttctgacggacagtgctgcctggctagagaagcacaaaaagtattttgcacttggactgctctatcattataataaccaagatgctgctgcagttcagttgtgggtgaacattgtgaatggcgatgtccaggactccacacgctcagacctgtatgaatacatcgtggattttcttacctactgcttagacgaggaactagtgtgggcctatgctgattgggtcctgcagaaaagtgaagaggtcggagttcaggttttcaccaagagacctttggatgaacagcagaagaacagttttaatccagacgacattatcaattgccttaaaaaataccctaaagcccttgtgaagtatctggaacatcttgtgatagacaagagactgcagaaagaagagtatcacacccacttagctgtgctgtacctggaagaggtgctgctgcagagggcctccgccagtggcaagggtgcagaggccaccgagacgcaggccaagctgcggcggctgctccagaaatctgatttataccgagtccactttcttctcgagaggctgcagggagctggcctgcccatggagagcgccatcctgcacgggaagctgggcgagcatgagaaggcgctgcatatcctggtgcacgagctgcaggactttgcagcggccgaggactactgcctgtggtgctccgagggccgagacccaccccaccgccagcaactctttcacacgctgctggccatctacctgcatgctggccccactgcccacgagctggccgtggctgccgtggacctgctgaaccgccacgccaccgaatttgatgcagcccaggtgctgcagatgctgcctgacacctggtcagtgcagctcctctgcccattcctgatgggggccatgagggacagcatccatgccaggaggaccatgcaggtggctctcggcctggccaggtccgaaaacttaatctacacctacgataagatgaagttgaaaggaagctcaatccaactctcagacaaaaagctttgtcagatatgccaaaatcccttttgtgagcctgtgtttgttagatacccaaatggtggtcttgtgcacacccactgtgccgccagcagacacacaaaccccagctcatccagtcctggcactcggacttgaaaagcttggcccaagggtgcgaggggaactccgagttctttctgagcctgctggacatgaagagcagatgaccaccatgctctgtgtcagccaggacgaagggagacatctgggtgccagggagccttccgtccatacgcaacaaggactcctcgctgctgaccaggctctatgaatgtacatggaaaacccctaaaaatccccaaaacagaaacatacaagagttcacctgtccaggtacatagtaatccaagacagaggtctactttgaaaaaaaaaaaagggagtcttcctcatgcagtccaagacccaggtgggggatcccccaccacccccacactccaacctttagactcatgtttgcactggaaacgtggcttcaccatggctggcgacaaagtcctctcttgcctgggtgagtggcgagggcacagagcctcatgggggtcagccttgccctcctgcagaaacacgttctccatccacgccgctcactcatgggcccatttcccagggttacctcgtgggctctgcctttgccctcagaaacggctgaccctggagaagtacctttgttccttctttcttcctctccggctctcagctcccaaaagattctgccttgtgtacccaagcactcactcttgggtgaactaatgcttctggctgcctagcaagtgaagatctgttgagaaactgagaacgctccaagagagaagctgctctcccctccttgaagaagccgcggacacgggaaacccacggcgggcaagggcccagctgtgtgctcctttcctgtcatggcatctgctgatttgaaactccatgacgaacacgttgaactaaacatttttatttaaatttgtatcatgttcgtagttgctctcttgttgagagagtcatctgtcctgtttgttaggggtattttttcttgttaaaatgtatctcctgttgaatactcgggaaattcaaagggaagtgtggtcagcacacactgagcgttcttttctggagaggccggttttagcctcgtacctttagcaggaccgacagcgggtggaagggcccgtgtgctggatgggggtgtcgcctcctggatggcacaccctcccgaggacatccagacaggctgtgtcaccctccagcactttatgtgcctgctctgaggtgtcctgaacacacagcaacggcctctccttcatcacaggccggggattccttttgtgtttctgtataacatcgatgacgagctgaagctgttgtcacttcactgccctctttggaatttcttcattgtgctgactgattctattaggggctaacaataaaggcagtctacccactactatcatgcttgggaaacaagcgtcagcttgtacatatgacaagagaggaccctgaatacaccctctcttcatcagcccaagccttactgaggtgggatgaagacctcattctctgttctttaaaacatgtttcgtgaactaatattggtccatgtattttttgtccttttgggactctaagtgggtcaagaagcaaaaacatccatgtgttgtttggggggaattggcaccattttttcctgactatgtttcaattaactaaagaataaatgatgaagaaattctccttgtaaaaaggcctacgtgaactgagttcaagaccgaaagtaccaggtcgattactatctacttcaaatttactccaagaaccattggcgcccgcttgtgccaattcctttttaaattcgacaaactttttgaatgcggccgcatttcgggctcattgggccaattccctctataggggggcgtttacaaatcaaatggcgcgtgtttcaaacggttgggatctgggaacacccctgggggtccccaacttccccctggggcgtccc

SEQ ID NO: 72606 - DNA, 5646 bp, Homo sapiens
  misc_feature (1398)..(1398): n is a, c, g, or t
ccagcccaggagccgcgggccggagcggggcggcggggccccaggccgcggggcggcgcgggacggcgggcgccggcgccgcagatcagccagtagacatgatgagcatcaaagcctttacgcttgtctctgctgtggagcgggagctgctgatgggcgacaaggagcgcgtcaacatagagtgcgtggagtgctgcggcagggacctctacgtgggcaccaacgactgcttcgtctaccacttcctgttggaggagaggccagtgcctgctgggccagccacgttcactgccaccaaacagctgcagagacacttgggcttcaagaagcccgtgaacgagctgcgcgcggcctcagcactcaacaggctgctggtgctgtgtgacaactccatcagcctggtcaacatgctgaacctcgagccagtgccttcgggggcccgcatcaagggggcagccacgtttgcactgaacgagaaccctgtgagtggggaccccttctgtgtagaagtttgcatcatctctgtcaaacgcagaaccatccagatgtttctggtgtacgaggaccgggtgcagatcgtcaaggaggtgtcgactgccgagcagcccctcgctgtggctgtggacggccacttcctgtgtctggctctgaccactcagtacatcatccacaattacagcacaggcgtctcccaggacctgtttccctactgcagtgaggagaggccgccgatcgtcaagaggatagggagacaggagttcctgctggcgggccccggagggctgggcatgtttgccacagtcgcagggatatcccagcgcgcccccgtgcactggtcggagaatgtgattggggcggctgtgtcctttccatacgtcatagcgctcgatgacgaattcattcacagtccacagcatgttggatcagcaacagaagcagacgctgccctttaaggagggccatatcctacaggactttgaaggaagagtgatcgttgccacaagtaaaggagtttacatcttggttccattacctttggaaaaacaaatacaggatcttctagcaagccgcagagtagaagaggctttggttttagcaaaaggagcccggaggaacattccaaaggaaaaatttcaggtaatgtacagaaggattctgcagcaggcgggatttatacagtttgcacaacttcagttcctggaagctaaagagctcttcagaagcggccagcttgatgtccgggagctgatctctctctaccccttcctgttgcccacctcctcctccttcacccggtcccaccctcctcttcatgagtacgcagacctgaaccagctgacccagggggaccaggagaagatggccaagtgcaaacgcttcctcatgagctacctgaangaggtccgcagcacagaggtagcaaatggctacaaggaggacatcgacacagccttgctcaaactgtatgcagaggctgaccacgacagcctgctggacctcctggtcactgagaacttctgtcttctgacggacagtgctgcctggctagagaagcacaaaaagtattttgcacttggactgctctatcattataataaccaagatgctgctgcagttcagttgtgggtgaacattgtgaatggcgatgtccaggactccacacgctcagacctgtatgaatacatcgtggattttcttacctactgcttagacgaggaactagtgtgggcctatgctgattgggtcctgcagaaaagtgaagaggtcggagttcaggttttcaccaagagacctttggatgaacagcagaagaacagttttaatccagacgacattatcaattgccttaaaaaataccctaaagcccttgtgaagtatctggaacatcttgtgatagacaagagactgcagaaagaagagtatcacacccacttagctgtgctgtacctggaagaggtgctgctgcagagggcctccgccagtggcaagggtgcagaggccaccgagacgcaggccaagctgcggcggctgctccagaaatctgatttataccgagtccactttcttctcgagaggctgcagggagctggcctgcccatggagagcgccatcctgcacgggaagctgggcgagcatgagaaggcgctgcatatcctggtgcacgagctgcaggactttgcagcggccgaggactactgcctgtggtgctccgagggccgagacccaccccaccgccagcaactctttcacacgctgctggccatctacctgcatgctggccccactgcccacgagctggccgtggctgccgtggacctgctgaaccgccacgccaccgaatttgatgcagcccaggtgctgcagatgctgcctgacacctggtcagtgcagctcctctgcccattcctgatgggggccatgagggacagcatccatgccaggaggaccatgcaggtggctctcggcctggccaggtccgaaaacttaatctacacctacgataagatgaagttgaaaggaagctcaatccaactctcagacaaaaagctttgtcagatatgccaaaatcccttttgtgagcctgtgtttgttagatacccaaatggtggtcttgtgcacacccactgtgccgccagcagacacacaaaccccagctcatccagtcctggcactcggacttgaaaagcttggcccaagggtgcgaggggaactccgagttctttctgagcctgctggacatgaagagcagatgaccaccatgctctgtgtcagccaggacgaagggagacatctgggtgccagggagccttccgtccatacgcaacaaggactcctcgctgctgaccaggctctatgaatgtacatggaatgaccaggctctatgaatgtacatggaaaacccctaaaaatccccaaaacagaaacatacaagagttcacctgtccaggtacatagtaatccaagacagaggtctactttgaccccacactccaacctttagactcatgtttgcactggaaacgtggcttcaccatggctggcgacaaagtcctctcttgcctgggtgagtggcgagggcacagagcctcatgggggtcagccttgccctcctgcagaaacacgttctccatccacgccgctcactcatgggcccatttcccagggttacctcgtgggctctgcctttgccctcagaaacggctgaccctggagaagtacctttgttccttctttcttcctctccggctctcagctcccaaaagattctgccttgtgtacccaagcactcactcttgggtgaactaatgcttctggctgcctagcaagtgaagatctgttgagaaactgagaacgctccaagagagaagctgctctcccctccttgaagaagccgcggacacgggaaacccacggcgggcaagggcccagctgtgtgctcctttcctgtcatggcatctgctgatttgaaactccatgacgaacacgttgaactaaacatttttatttaaatttgtatcatgttcgtagttgctctcttgttgagagagtcatctgtcctgtttgttaggggtattttttcttgttaaaatgtatctcctgttgaatactcgggaaattcaaagggaagtgtggtcagcacacactgagcgttcttttctggagaggccggttttagcctcgtacctttagcaggaccgacagcgggtggaagggcccgtgtgctggatgggggtgtcgcctcctggatggcacaccctcccgaggacatccagacaggctgtgtcaccctccagcactttatgtgcctgctctgaggtgtcctgaacacacagcaacggcctctccttcatcacaggccggggattccttttgtgtttctgtataacatcgatgacgagctgaagctgttgtcacttcactgccctctttggaatttcttcattgtgctgactgattctattaggggctaacaataaaggcagtctacccactactatcatgcttgggaaacaagcgtcagcttgtacatatgacaagagaggaccctgaatacaccctctcttcatcagcccaagccttactgaggtgggatgaagacctcattctctgttctttaaaacatgtttcgtgaactaatattggtccatgtattttttgtccttttgggactctaagtgggtcaagaagcaaaaacatccatgtgttgtttggggggaattggcaccattttttcctgactatgtttcaattaactaaagaataaatgatgaagaaattctccttgtagcacaactgtatgctgtgtaaattggtgtgagctcaaagcccagtcatgtgttttacctgtgggtgactctgttgtagaatggtcatattactgcatatgttatcatgacaacttgtgagtttgagtttatatttctcaaagaacaagttacccgtatatgcaacattgcgccattaaaagcttatttctctgtacacaaaatgggtaaaatcttgaaaaaacttagtaatttctcattcctaacacacagacagagtctcactctgtcacccaggctggagtgcagtggcgcaatctcggctcactgcaacctccacctcctgggttcaagcaattctgctgcctcagcctcccgagtagctgggactacaggtgcatgccaccacgcccagctaatttttgtatttttagtagagacggggtttcaccatgttggccaggatggtctcggtctcctgacctcgtgatctgcctgcctcggcctcccaaagtgctgggattacaggcgtgagccactgcgcccagccaacactagtcatttttattttttcactgaacattgatcaatactctaaaatgtttgtcatcctttagaataatgggaattaaagttgagcagttttccatctctaccaaatccttcaccacaagcagcattctattacagtatgaagaattgtctcatatgttaaaactgtacttttctctaacctttctctcactcctacaaggcccttttctcaaatcatatttctgagagaaatgtatggttctttctcacaggcctgctgatttgtaactgtgccatcgaatagagcaattagatccatcagacctttttcccctcattaggttcagtggaaccattctggttaaaacagcatgaactgaactcagtttacattcatattctatgggcaataccatttggtttttggaactgtttatctgctgttccctatcaagtattaatgtagggatgtcactcaggctgcgttgcactgggctgagttcaactgcgacgctctcactgacgcgtgcttacatgtgcttctcacttccggagcacaggcaggtggctgcggggtcccagctctgaatggatgcccatgatgcaactggggcagcccttgctttttgcttgctctcccacagaaacctttgtccttgcaactttatcctttgtcccgattgggtcccagatacacaaaatgtacaaatgtaaacttgctcattttattaaaattcttttagttctttgttctttctgtaattttttaaaataaaaattgccttgatggagtgatggttttcactcgcaccatacctagtctaaataaagagttctagaatctgta

SEQ ID NO: 72607 - DNA, 351 bp, Homo sapiens
taacatgagaataagatgaaacctatctcataagactgtcatggtaatcaaatgagtaaatacaggcagggcgcagtggctcacgcctgtaatcccagcactttgggaggccaaggctggtgaatcacttgaggtcaggcattcgagaccagcctggccaacacagtgaaacccccatctctactaaatatacaaaaattagccaggtgttgtggtgggcacctgtaatcccagctacttgggaggctggggcaggagaatcccttgagcccaggaggcagaggttgcagtgagctgagattgtgccactgcactccagcctgggtgacagagtgagactccatctcaaaa

SEQ ID NO: 72608 - DNA, 155 bp, Homo sapiens
ccataatgtcaaacactacatattttttaaaagaatgaaaatttggacagaggttgtaaagtgatggcccaaaatggaaaggatgtatatctggccaataatttttaaaaataaaatattattaacctcctagtatatatagaaaatgaaatctg

SEQ ID NO: 72609 - DNA, 484 bp, Homo sapiens
agtagagacagggttttgccatgttggccaggctggtcttgaactcctgacctcaggtgatcacccgccttggcctcccaaagtgctggcattacaggcctgagccaccgcacccagccgtaattgatattttttaaaagaattatatactaaaacttcttcatttctcacaaattagtttaggcctgcctttaataagcagttcaaacccaagattcaaggaatagggattctgaaagagaggtttttgttaggcgcattttaatatctttctttctaatttgaatttcactcaaatgagcactttaaatatgaatcaaaatgcctattttaatattagaagtaacataaacatattgtagatgactattgaaaaagctctagttaaaaattttatgataatgattggatagcattaagatattatgtctattgttaaggtgagtaatataaaaggaagttttagccaagcttacagagaata

SEQ ID NO: 72610 - DNA, 423 bp, Homo sapiens
tttttaagcctctcactcaccataggttaagagtatgatccactctaccggttcactgccagttctctgtatttacattaaaactgggtgtacattttaaaatatagattcctgaatcccaccaccagagatgatcccagaatctgccttttagcaagaaccccaaagtattccagtgcaggtgaccactgaccatgcattgaaaaacacagtgccctgacacatgagtgtaaactgagctgagagcaagggccatgaaattctccaagaatcaaaagtattttgtccttgaacttccaagtgaagatgtaaaactggttaatataaaaaccactgttcagtttattacaaatcatttcccacttcctgttgctacaaaaagcagcctttcctttcaaaagatgttttccagggctcagggga

SEQ ID NO: 72611 - DNA, 336 bp, Homo sapiens
gtcatgaatatgttttaaatgtacgttatttaaaaatttggacaattttaacacctttatcataatgtgtaatgtttttgcatttcctcaaacacattttgctaattgctgctttagagacatcttaagaaacatgacttcaaagtagcgtgctgagttctatactacaaaattacatcttttggatcttcaaaagcacattgacttttacttaaacagtaatttgtctcaatttatttctgtaaataaattggagagttggaataattttgggtggacacattaccctaattattgcaattccccacagaattttgttttataaactcttcatta

SEQ ID NO: 72612 - DNA, 920 bp, Homo sapiens
atagctcaatttcacttacagatacatttaacgccactagatacaaagtaaaaactttgtctattatctgctgaatgtgtcatttcccacaggtgctaagaacgctcaagccatggagagagatgcatttggagttgtttacattcagacaaagctcatctggttgtttgcagctagtcacaaggtggcccattgtcctgccttgcttttctccattatctctgggtcaagttgtttctttgataaatccaaatcatgaaaatagcctgctgaaagaattcactttgaaaatgccacaaaacagacaatggaaaaatgagatgaacaagtgcgaatccatcattcttctcaggttctggaaaaatgctggttttcagctcctggaaaattctcacaagacatctgttttgttttatatcttcatttgtttccattcatctttcctactgtagacactgtctatgatttttttgtgtgggggttttggcaaagtgcatacgattactttgaatttagagaattaaattgtatttatccactgaaagctgtttttaagatctagctgtgttgtcacttggatatctagtttattacttctacttgcaaagtagtacaatgagataccaaaccaccatattttttccatctattttctcaattatggacacttttcaacttattactacagtagggaagttaaaggctatttgaattattggagaatagagatacctaggatcagaattaccaagtcatagaccgaaactttggctaagacctaaacttaatatgggtaaatattgttacattgctccctagaatattgatatggtttggatttgtgtccccacgcaaatctcatgttgaattgtaatcctcaatgttggaggtggggaatggtaaggggtgattagatcctg

SEQ ID NO: 72613 - DNA, 295 bp, Homo sapiens
atagctcaatttcacttacagatacatttaacgccactagatacaaagtaaaaactttgtctattatctgctgaatgtgtcatttcccacaggtgctaagaacgctcaagccatggagagagatgcatttggagttgtttacattcagacaaagctcatctggttgtttgcagctagtcacaaggtaagcaggggcgtgcatgcgcacacacacacacacgtgaattatatatttcaaaataaattggaattacataaattaaaaaataaatattttaaaatatgatttttaaat

SEQ ID NO: 72614 - DNA, 228 bp, Homo sapiens
ctcagatgtttggacaatgtgtcgtcatgtctgcaacttttcagtggttcagccaaagaagaaattgtccgccatgaacaagagcactctcctacctaacggtgccattgtcacgcctaagaaacattcatacaatcttattgtctgatacagactgtatgtaaatccccaattgtcccaaaaatgtccaagagcttattgagtctaaaatacaacccaagatcacct

SEQ ID NO: 72615 - DNA, 297 bp, Homo sapiens
tacaagaaaatcccgatggcactggcagatatctcttagatgacagcaaaagcacaatttatatttaaatctttgatccacttcgatttaacttttgtatacagtgtgaggcatatattgagtttatttttttaaatatagttatctggttattctagcaccatttgttaaaaacgctagcctttttccacagcactgcctttgtaactttgtcaaaaatcagttgtctaaatacatgtggatctaattttggactcactattcttgtctgttgatctatatgcctatctttatgcc

SEQ ID NO: 72616 - DNA, 754 bp, Homo sapiens
  misc_feature (232)..(232): n is a, c, g, or t
  misc_feature (248)..(249): n is a, c, g, or t
  misc_feature (265)..(265): n is a, c, g, or t
gtaagtaagagcaactcctatctctacagggcagggagggcagggacaaggatccctcatggagcaggaaaatgtatgtgcccagggtggggtcggggggaacataaacaatgaacactgagaccaggtgtgcttgaaatgaccgtgtacagaggtcgctgccctgagtgggaagttctcaaggtagcaggccctctatcctctccacacctcaagtctttatctggggatngaatagctgcggaacnnaggaacttgcagagcnaggggttcagaggggtgaagaagcatgtttcagttctgccttttaaatgatcccaaaaaggttagcagttttcaaatgacatttgcagacagcctcatttaattccatgagaagggtgagcaaaggattatcttgttgaaactgattcctggagagactgagcaccgtacctgagttcaaacttgggaatgttctagatggtgactcaggcccaggcaccaaccagcagaatgggcctcagcctgacaacccttctgtaccaggcctgactctttggttgctgaactttggagaggcctgggggggtcagcggcaggcagacgagtgagtggctttggtgacaggtcctcaggggcagccaggcagtgtgactctcgttcaatagtaacgtttgtcagagcgttgtcaccaccatccgctctgccctatctctgacattgctatggagagcctctaattgttccttgtgtctttctgtttgtccccaca

SEQ ID NO: 72617 - DNA, 499 bp, Homo sapiens
aaaaatttaatttatagcttatgaatttaacttatagataatttgtagctaacttaatttacagcttaatgaagttaaataacatacaaggtattttctctataattttattttaagagcaatttaaaattataagtaggtattttttcagtttttattattcttcttccactgctttattcacattttaggaatactttttaatcattaattccatatgaaaagcataggtgggagggaagaaaaataatcacatatacatacagatgtttagtcttaatttaactttagacacaaaagaatttttattctattaaatgcatgaaccataattgagtaaatataatattttcatcttcgtaatacagaacgtgtactttgttttactttggtttaagcagaccatatgcataaaatcttaatgaaataaacatgtaaattattggtgaatatccaaactataaaaggattcttcactctacaaaagtgatccctaatg

SEQ ID NO: 72618 - DNA, 489 bp, Homo sapiens
cagcatccttagttaaaataaaatctccaacgaaagcatggatataatccccatttccagaaaatcccagaaagaaatgcagcccttgttcagtccaactccatcatttgatagattaggaaaataggttctagagagtgacttgtccactgtcaggagatggtgactgtggcgcgtcatctgactccagcctacttaatgcatttcagtctcttcggccttaagggctcctgctgctcacctgaaatcattcccaaggaacccacaagagcaggttccctgggaggattcctgagaacacctacacacaagcctcagagatctgccaagacattctctttctgataaatactattaaatatttttctatcaaatagttgccaaatgacctgctccagtcaaaactcaatctgacttgtgactacaaagtaatctgaggaatcccaaagatatataaaaatctatccatctaagtcatctctcttcaaa

SEQ ID NO: 72619 - DNA, 1882 bp, Homo sapiens
catttattaaggactctctgctccagcctctcactctcactctcctccgctcaaactcagctcacttgagagtctcctcccgccagctgtggaaagaactttgcgtctctccagcaatgcatctccttgcgattctgttttgtgctctctggtctgcagtgttggccgagaactcggatgattatgatctcatgtatgtgaatttggacaacgaaatagacaatggactccatcccactgaggaccccacgccgtgcgactgcggtcaggagcactcggaatgggacaagctcttcatcatgctggagaactcgcagatgagagagcgcatgctgctgcaagccacggacgacgtcctgcggggcgagctgcagaggctgcgggaggagctgggccggctcgcggaaagcctggcgaggccgtgcgcgccgggggctcccgcagaggccaggctgaccagtgctctggacgagctgctgcaggcgacccgcgacgcgggccgcaggctggcgcgtatggagggcgcggaggcgcagcgcccagaggaggcggggcgcgccctggccgcggtgctagaggagctgcggcagacgcgagccgacctgcacgcggtgcagggctgggctgcccggagctggctgccggcaggttgtgaaacagctattttattcccaatgcgttccaagaagatttttggaagcgtgcatccagtgagaccaatgaggcttgagtcttttagtgcctgcatttgggtcaaagccacagatgtattaaacaaaaccatcctgttttcctatggcacaaagaggaatccatatgaaatccagctgtatctcagctaccaatccatagtgtttgtggtgggtggagaggagaacaaactggttgctgaagccatggtttccctgggaaggtggacccacctgtgcggcacctggaattcagaggaagggctcacatccttgtgggtaaatggtgaactggcggctaccactgttgagatggccacaggtcacattgttcctgagggaggaatcctgcagattggccaagaaaagaatggctgctgtgtgggtggtggctttgatgaaacattagccttctctgggagactcacaggcttcaatatctgggatagtgttcttagcaatgaagagataagagagaccggaggagcagagtcttgtcacatccgggggaatattgttgggtggggagtcacagagatccagccacatggaggagctcagtatgtttcataaatgttgtgaaactccacttgaagccaaagaaagaaactcacacttaaaacacatgccagttgggaaggtctgaaaactcagtgcataataggaacacttgagactaatgaaagagagagttgagaccaatctttatttgtactggccaaatactgaataaacagttgaaggaaagacattggaaaaagcttttgaggataatgttactagactttatgccatggtgctttcagtttaatgctgtgtctctgtcagataaactctcaaataattaaaaaggactgtattgttgaacagagggacaattgttttacttttctttggttaattttgttttggccagagatgaattttacattggaagaataacaaaataagatttgttgtccattgttcattgttattggtatgtaccttattacaaaaaaaatgatgaaaacatatttatactacaaggtgacttaacaactataaatgtagtttatgtgttataatcgaatgtcacgtttttgagaagatagtcatataagttatattgcaaaagggatttgtattaatttaagactatttttgtaaagctctactgtaaataaaatattttataaaactaaaaaacgtca

SEQ ID NO: 72620 - DNA, 1856 bp, Homo sapiens
gctggtacggtctgggatttagggatcaactcagctcacttgagagtctcctcccgccagctgtggaaagaactttgcgtctctccagcaatgcatctccttgcgattctgttttgtgctctctggtctgcagtgttggccgagaactcggatgattatgatctcatgtatgtgaatttggacaacgaaatagacaatggactccatcccactgaggaccccacgccgtgcgactgcggtcaggagcactcggaatgggacaagctcttcatcatgctggagaactcgcagatgagagagcgcatgctgctgcaagccacggacgacgtcctgcggggcgagctgcagaggctgcgggaggagctgggccggctcgcggaaagcctggcgaggccgtgcgcgccgggggctcccgcagaggccaggctgaccagtgctctggacgagctgctgcaggcgacccgcgacgcgggccgcaggctggcgcgtatggagggcgcggaggcgcagcgcccagaggaggcggggcgcgccctggccgcggtgctagaggagctgcggcagacgcgagccgacctgcacgcggtgcagggctgggctgcccggagctggctgccggcaggttgtgaaacagctattttattcccaatgcgttccaagaagatttttggaagcgtgcatccagtgagaccaatgaggcttgagtcttttagtgcctgcatttgggtcaaagccacagatgtattaaacaaaaccatcctgttttcctatggcacaaagaggaatccatatgaaatccagctgtatctcagctaccaatccatagtgtttgtggtgggtggagaggagaacaaactggttgctgaagccatggtttccctgggaaggtggacccacctgtgcggcacctggaattcagaggaagggctcacatccttgtgggtaaatggtgaactggcggctaccactgttgagatggccacaggtcacattgttcctgagggaggaatcctgcagattggccaagaaaagaatggctgctgtgtgggtggtggctttgatgaaacattagccttctctgggagactcacaggcttcaatatctgggatagtgttcttagcaatgaagagataagagagaccggaggagcagagtcttgtcacatccgggggaatattgttgggtggggagtcacagagatccagccacatggaggagctcagtatgtttcataaatgttgtgaaactccacttgaagccaaagaaagaaactcacacttaaaacacatgccagttgggaaggtctgaaaactcagtgcataataggaacacttgagactaatgaaagagagagttgagaccaatctttatttgtactggccaaatactgaataaacagttgaaggaaagacattggaaaaagcttttgaggataatgttactagactttatgccatggtgctttcagtttaatgctgtgtctctgtcagataaactctcaaataattaaaaaggactgtattgttgaacagagggacaattgttttacttttctttggttaattttgttttggccagagatgaattttacattggaagaataacaaaataagatttgttgtccattgttcattgttattggtatgtaccttattacaaaaaaaatgatgaaaacatatttatactacaaggtgacttaacaactataaatgtagtttatgtgttataatcgaatgtcacgtttttgagaagatagtcatataagttatattgcaaaagggatttgtattaatttaagactatttttgtaaagctctactgtaaataaaatattttataaaactaaaaaacgtca

SEQ ID NO: 72621 - DNA, 937 bp, Homo sapiens
  misc_feature (917)..(917): n is a, c, g, or t
catttattaaggactctctgctccagcctctcactctcactctcctccgctcaaactcagctcacttgagagtctcctcccgccagctgtggaaagaactttgcgtctctccagcaatgcatctccttgcgattctgttttgtgctctctggtctgcagtgttggccgagaactcggatgattatgatctcatgtatgtgaatttggacaacgaaatagacaatggactccatcccactgaggaccccacgccgtgcgactgcggtcaggagcactcggaatgggacaagctcttcatcatgctggagaactcgcagatgagagagcgcatgctgctgcaagccacggacgacgtcctgcggggcgagctgcagaggctgcgggaggagctgggccggctcgcggaaagcctggcgaggccgtgcgcgccgggggctcccgcagaggccaggctgaccagtgctctggacgagctgctgcaggcgacccgcgacgcgggccgcaggctggcgcgtatggagggcgcggaggcgcagcgcccagaggaggcggggcgcgccctggccgcggtgctagaggagctgcggcagacgcgagccgacctgcacgcggtgcagggctgggctgcccggagctggctgccggcaggttgtgaaacagctattttattcccaatgcgttccaagaagatttttggaagcgtgcatccagtgagaccaatgaggcttgagtcttttagtgcctgcatttgggtcaaagccacagatgtattaaacaaaaccatcctgttttcctatggcacaaagaggaatccatatgaaatccagctgtatctcagctaccaatccatatttttttttttttttttatattataacaaacttttttcttaatccattttttcccttttaattttnacccaccttttcttcacctt

SEQ ID NO: 72622 - DNA, 126 bp, Homo sapiens
taattactgtctagcacttttctgtgtagatttcctctgggcactcttggattatgggaatccagatgggggaaatgacctggctttgctatcttattttccccagagcagcatttaacaattgct

SEQ ID NO: 72623 - DNA, 1570 bp, Homo sapiens
cggggcagctctgaggaacaaggtggaagctcagagcgctggtctccaccctggtgcccctgggctggtgctggcagtgggagccgtggctgtggatgagagacatagacgagagagtgagatggcctggtttgccctctacctcctgagccttctctgggctacagctgggactagtacccagacccagagttcatgctccgttccctcagcacaggagcccttggtcaatggaatacaagtactcatggagaactcggtgacttcatcagcctacccaaaccccagcatcctgattgccatgaatctggccggagcctacaacttgaaggcccagaagctcctgacttaccagctcatgtccagcgacaacaacgatctaaccattgggcagctcggcctcaccatcatggccctcacctcctcctgccgagaccctggggataaagtatccattctacaaagacaaatggagaactgggcaccttccagccccaacgctgaagcatcagccttctatgggcccagtctagcgatcttggcactgtgccagaagaactctgaggcgaccttgccgatagccgtccgctttgccaagaccctgctggccaactcctctcccttcaatgtagacacaggagcaatggcaaccttggctctgacctgtatgtacaacaagatccctgtaggttcagaggaaggttacagatccctgtttggtcaggtactaaaggatattgtggagaaaatcagcatgaagatcaaagataatggcatcattggagacatctacagtactggcctcgccatgcaggctctctctgtaacacctgagccatctaaaaaggaatggaactgcaagaagactacggatatgatactcaatgagattaagcaggggaaattccacaaccccatgtccattgctcaaatcctcccttccctgaaaggcaagacatacctagatgtgccccaggtcacttgtagtcctgatcatgaggtacaaccaactctacccagcaaccctggccctggccccacctctgcatctaacatcactgtcatatacaccataaataaccagctgaggggggttgagctgctcttcaacgagaccatcaatgttagtgtgaaaagtgggtcagtgttacttgttgtcctagaggaagcacagcgcaaaaatcctatgttcaaatttgaaaccacaatgacatcttggggccttgtcgtctcttctatcaacaatatcgcggaaaatgttaatcacaagacatactggcagtttcttagtggtgtaacacctttgaatgaaggggttgctgactacatacccttcaaccacgagcacatcacagccaatttcacacagtactaacgaagaggtgggttcagcttctatcaaacatctccaaaggatgggtgaaattttttccacttcattttaaatctatgcaaaaaagcgaatgcctgtgatgctaccatattcctggtaaaaacatggagaaccactatgtagaataaaaatgcaaagttcactggagtctcaacatctatgactcatgaaaataaa

SEQ ID NO: 72624 - DNA, 993 bp, Homo sapiens
  misc_feature (31)..(31): n is a, c, g, or t
tagaggatccccatgcgcgacgcttccatcnatgtagacacaggagcaatggcaaccttggctctgacctgtatgtacaacaagatccctgtaggttcagaggaaggttacagatccctgtttggtcaggtactaaaggatattgtggagaaaatcagcatgaagatcaaagataatggcatcattggagacatctacagtactggcctcgccatgcaggtaaacacgtgctggatgctcttggttgggttcctgccaataagcctggattgcagaatcaagaggccaggcttctactaacatctctgtgaaagtccagctagtatgacctgagatatattctttgtggtgcctgggcctcagtttctctactggtaaaatgcaggctctctctgtaacacctgagccatctaaaaaggaatggaactgcaagaagactacggatatgatactcaatgagattaagcaggggaaattccacaaccccatgtccattgctcaaatcctcccttccctgaaaggcaagacatacctagatgtgccccaggtcacttgtagtcctgatcatgaggtacaaccaactctacccagcaaccctggccctggccccacctctgcatctaacatcactgtcatatacaccataaataaccagctgaggggggttgagctgctcttcaacgagaccatcaatgttagtgtgaaaagtgggtcagtgttacttgttgtcctagaggaagcacagcgcaaaaatcctatgttcaaatttgaaaccacaatgacatcttggggccttgtcgtctcttctatcaacaatatcgcggaaaatgttaatcacaagacatactggcagtttcttagtggtgtaacacctttgaatgaaggtgagggaagaaaagacataggcgttatcttccatagtctgaaggctacattctttaattattttttcatttaatttattcattcattcacttaattaataattatgag

SEQ ID NO: 72625 - DNA, 975 bp, Homo sapiens
  misc_feature (31)..(31): n is a, c, g, or t
tagaggatccccatgcgcgacgcttccatcnatgtagacacaggagcaatggcaaccttggctctgacctgtatgtacaacaagatccctgtaggttcagaggaaggttacagatccctgtttggtcaggtactaaaggatattgtggagaaaatcagcatgaagatcaaagataatggcatcattggagacatctacagtactggcctcgccatgcaggctctctctgtaacacctgagccatctaaaaaggaatggaactgcaagaagactacggatatgatactcaatgagattaagcaggggaaattccacaaccccatgtccattgctcaaatcctcccttccctgaaaggcaagacatacctagatgtgccccaggtcacttgtagtcctgatcatgaggtacaaccaactctacccagcaaccctggccctggccccacctctgcatctaacatcactgtcatatacaccataaataaccagctgaggggggttgagctgctcttcaacgagaccatcaatgttagtgtgaaaagtgggtcagtgttacttgttgtcctagaggaagcacagcgcaaaaatcctatgttcaaatttgaaaccacaatgacatcttggggccttgtcgtctcttctatcaacaatatcgcggaaaatgttaatcacaagacatactggcagtttcttagtggtgtaacacctttgaatgaaggggttgctgactacatacccttcaaccacgagcacatcacagccaatttcacacagtactaacgaagaggtgggttcagcttctatcaaacatctccaaaggatgggtgaaattttttccacttcattttaaatctatgcaaaaaagcgaatgcctgtgatgctaccatattcctggtaaaaacatggagaaccactatgtagaataaaaatgcaaagttcactggagtctcaacatctatgactcatgaaaataaa

SEQ ID NO: 72626 - DNA, 386 bp, Homo sapiens
tgtgtgtgcgtgtgcatgtgcgtgtgtgtgtttcaggagctgaccctggctgtgaggatggccttcctatccttcccttctcctggctgccctatccttcccttctcctggctgcctcccattgtgacatggatttttctctcatctttctctccctactccccttgcagcatgagaggcccagtacctgtaagactaccaggctccatcactctccagagaggccagttctgcctcttaggaagggcctagatcagcgcaaatctcaccatcatgatgtccccaactgctccgcccgtgtatgtgttgggtatttccaactgtccccagcaaagcctgcctcctccccacctcctgagccctgtggggtatcaggagcctcacca

SEQ ID NO: 72627 - DNA, 338 bp, Homo sapiens
ttagcttattttccttagatcagaaattatttttaaaaaagtaaaaaataacaatcttctcccatttgaaaatgccctttaaataggaaaagttattaccattagtaagagcttgaggcaatttgttcagccacaaaaccaagagagtggatctttaatacccctttcatgtatatatgttggagggacatttgtacaaatacaatggctctacatgcacaaataaacacatcaactaactgaactgatttgcgaaggcttagctgctggcagccctttatattttgttgcttttactttctaattctactgaatttctattacggctacataagttt

SEQ ID NO: 72628 - DNA, 358 bp, Homo sapiens
ggaagatgtacaatgcacatgtgcagccaaactgctacccacaggcggaacatcgccacaccccggacggtgccacgagtcccacttctgtctccctcccatccccagaagaaaccaccggtctagtattttccacctttacgtaattcctggctactcccactccatcaagcatgtgtgattgatccgtatcgtgcgcacaggcagcttgcttctgtttttgctaaaaggccattgtctgaatagatcacaattagctgagcatggtggtcgagcattccacatctaatccctagagcctgtgaacgtgacttactggaaacagtttttgcagatgtccacaaggaaaatgttaatt

SEQ ID NO: 72629 - DNA, 867 bp, Homo sapiens
cggaggttgcagtgagccaagtagctgggatcacaggcatgcgccaccatgcccagccagttttgtattttcagtagagtcgaggtttctccatgttggtcagactggtctcgaactcccgacctcaggtgatccgcccccctctgccttccaaagtgctgggattacaggcatgagccaccgctcccagctctttttgcatattctttatcgtactaaagaacaactcaataaaataaatactttattcagtatttctaatacccaaggtaaagacattctaacaataaacctgtgcaactagagtagcatagcctcgggctgttgcttttatctccagccagtactactgcctaaagaatatgaaaggaaagatttctgtattcatttaagaattttgatttgttaacaagcagtttttactagctatgcatctggaatgactaatgactaatgagaattacaggcccacaatagcccccacaatttaatcattcatctgtctactgttcacatatttattgagcacccatctgtgtgaggcactctgctaggtattctggaaaaaaattgagtttcataaatatccattgtgtcatagatacaaatttaagacatcatgaggtctacttgttaaccttactgtgtatgatctctactttcaagatcttcagaggagatactttattgctactagcagaataatttaatagaactcccttcccgcaaggcgcgtctcccgccctcccgccgggcgcgccttttcgcggggcccgcgcccttctaagtgttttctgactactgtaccaaacttggttgtgtctgtggtgcccggctgccgtggcactgcgcttgtcttaaacatag

SEQ ID NO: 72630 - DNA, 869 bp, Homo sapiens
cggaggttgcagtgagccaagtagctgggatcacaggcatgcgccaccatgcccagccagttttgtattttcagtagagtcgaggtttctccatgttggtcagactggtctcgaactcccgacctcaggtgatccgcccccctctgccttccaaagtgctgggattacaggcatgagccaccgctcccagctctttttgcatattctttatcgtactaaagaacaactcaataaaataaatactttattcagtatttctaatacccaaggtaaagacattctaacaataaacctgtgcaactagagtagcatagcctcgggctgttgcttttatctccagccagtactactgcctaaagaatatgaaaggaaagatttctgtattcatttaagaattttgatttgttaacaagcagtttttactagctatgcatctggaatgactaatgactaatgagaattacaggcccacaatagcccccacaatttaatcattcatctgtctactgttcacatatttattgagcacccatctgtgtgaggcactctgctaggtattctggaaaaaaattgagtttcataaatatccattgtgtcatagatacaaatttaagacatcatgaggtctacttgttaaccttactgtgtatgatctctactttcaagatcttcagaggagatactttattgctactagcagaataatttaatagaactcacattcctcaaaagaaagagatactcttttatttctttgctgaagaattcatttaacagcactttcttctaagtgttttctgactactgtaccaaacttggttatatctttagtgctccccatacatgggaatcagttgtcttaaacatag

SEQ ID NO: 72631 - DNA, 527 bp, Homo sapiens
aagtaacccaccaaagtgaaaaagaggaacaagttctaacccaatgcaggtttaaaacataaccaaaagaacaaaagagagagcttgacacaccaatcttgaggttatcacgctataatagagaatggactcattaatatgggattacagaggaaggaatggttaagaaaaagacatggcctctgactgctccaaaaaaggataagcagggcttcacagaagaggtgacaggaccagcttctctgcaacctgtcagaagcaccagcaccagccaggtggcaccctcccttagactctgacagccagactctccttcaacctcctgaagtggtgcaggagacaagtggtaccctcagagttctgcgtcccagcctggcagggctcctcctctgaggtctggtaactctcagccaagattgttacagttactatctctgtggtacctgtgtccccttttttgtttttccatcctgccaatgcctgtttagccaattatctatattaaattctctctgttaaaacaaatt

SEQ ID NO: 72632 - DNA, 614 bp, Homo sapiens
aagtaacccaccaaagtgaaaaagaggaacaagttctaacccaatgcaggtttaaaacataaccaaaagaacaaaagagagagcttgacacaccaatcttgaggttatcacgctataatagagaatggactcattaatatgggattacagaggaaggaatggttaagaaaaagacatggcctctgactgctccaaaaaaggataagcagggcttcacagaagaggtgacagcaggtttctggatggcagatcattcaaccttctttttcttgagttttctactctgctgtcatcttccactcatttctgcttcattttgtgattcgttaacagaaaaggaagtggaatggaataaaatcccccaatacagtacaattatacattaatggctgtaatgtgaagagcatcacacacgaagagagccatcttccagaaataagtttatacactctctcctctaattgcatcaggactttttctgtttctttttcttcagttttgatagtatattgctatttcctcttacatacttatttttgtctccacccccctacctggcttcctctcgtatgtttttcttgtctctccgtctacctctccgccctgcttctcag

SEQ ID NO: 72633 - DNA, 460 bp, Homo sapiens
ctctaccaatagggggcactaaggaagaccgaaaggcagtaggaggcaacagggaattgctcctgcctattctttctgttgcccccgcaggaatttattgccatgtggtttactccagcatcactggttgtttgcagctttctagtttcttccatcattcccaggaccagcttctctgcaacctgtcagaagcaccagcaccagccaggtggcaccctcccttagactctgacagccagactctccttcaacctcctgaagtggtgcaggagacaagtggtaccctcagagttctgcgtcccagcctggcagggctcctcctctgaggtctggtaactctcagccaagattgttacagttactatctctgtggtacctgtgtccccttttttgtttttccatcctgccaatgcctgtttagccaattatctatattaaattctctctgttaaaacaaatt

SEQ ID NO: 72634 - DNA, 2344 bp, Homo sapiens
aagtaacccaccaaagtgaaaaagaggaacaagttctaacccaatgcaggtttaaaacataaccaaaagaacaaaagagagagcttgacacaccaatcttgaggttatcacgctataatagagaatggactcattaatatgggattacagaggaaggaatggttaagaaaaagacatggcctctgactgctccaaaaaaggataagcagggcttcacagaagaggtgacagaaaaggaagtggaatggaataaaatcccccaatacagtacaattatacattaatggctgtaatgtgaagagcatcacacacgaagagagccatcttccagaaataagtttatacactctctcctctaattgcatcaggactttaccagataatgttcttccagatctgaaaaggaaaatgcctaaaagagcttccaaactcatttttgaataatactaggctacaaagaattacactgtgaattcattaagggtaacaccaaatcactaaacagcactgtttgtacagaaatgtcgaaaagctgtggaaataatttagcggccatttctgtaggaatttcgcttcttttactcttagtggtttgtggaattgggtgtgtttggcactggaaacaccgtgttgccacacgatttaccttaccgaggtttttacaaaggagaagcagcaggagaaaagtctgtactaaaacattcttgggcccccgcatcattggcttaaggcatgaaatctcagttgaaacccaagaccacaaatctgctgtcaggggaaataacacacacgacaactatgaaaatgtggaagcaggtcctcccaaagctaaaggaaaaaccgataaggaactatatgaaaacacagggcagtctaatttcgaggagcatatctatggaaatgagacatcttctgactattataacttccagaagcctcgtccttctgaagttcctcaagatgaagatatatacattcttccagattcatattagcttttcaaaatattgacttttgttattggatgataaatattcactgtaatttttcaacagcaaagacaaggaatcaaactaaatgttgatcaactgtagactggataaagaaaatgtggtacacatacaccatagaatattatgcagccgtaaaaaaagaacaaaactaacatgggaacagaaaatcaaataccacatattctcacttaaaagtgggagctaaataataagaacacatggagagaaggagaggaacaacagacactggggcctacttgagggaggacagtggaaggagggagaggttcagggaaaaaaaaaatatcaggtactatgcttagtacacacatgatgaaataatctgtacaccaaacccccaagtcacaagtgttcctacataacaaacctgaacatgtacccctgaacataaaattataattaaaatattaaaaataattcactgtgatttttattgtactgatgccattcttaatcaagttctgataagtggatggtctctgcctatctccacctttctgaatcctatgtgtatcgctgtggattaattctagatatcttctccaccctccttgcaccagactaaatctgtattatgtgatattgattcttccttctaaatattacccgttatctctttcctttatttctaccattatctttatctggctcagaattattgtcataggctcctaactgttcctcctgcttctagtttctacccactcaatcaattaccgatggtgttgccagatttatcttcagaaaatattcctaacagccacattatttctttcacttaaaatgttttaatgccccctctttgcaaaagacataatacccataatttgaactccaaaatttatggttttccacaattggttccaattcacttttccagtgacttctcttactatctctcatttctttgccttcagcagaatcatcttaaaacctgccaaacttatccttccttcacagctttgcttttctgcctcttctctcaagcctgcttcagatcataagttcttccacacatctcctgaatcactccaaacccgcatttacctttttattttctgatataagctttgatgcctcttcaattcttaggacatttaaacatatgaatgttgccacagcattttattacctagcttcatatgaaaatgtcttaaattcccacctaaatgaaaagaaactgcccaaatgcctagaacatcacataaggcactaaatgcctcatgttttactgacgggaattgaattgtacattttgctgagtagttttgagaaaaaaatctaataaattcatctgttattcatccata

SEQ ID NO: 72635 - DNA, 2844 bp, Homo sapiens
aagtaacccaccaaagtgaaaaagaggaacaagttctaacccaatgcaggtttaaaacataaccaaaagaacaaaagagagagcttgacacaccaatcttgaggtgttgtgccattctctgggaacatacagatgaaatgacctgaaccctgcccaccatttaaccaagtaagaatacaattctctctcatttaggttatcacgctataatagagaatggactcattaatatgggattacagaggaaggaatggttaagaaaaagacatggcctctgactgctccaaaaaaggataagcagggcttcacagaagaggtgacaggtaataaagatgattgcacgtgtctgtatatgtccctttttttctattgtgctcagaacattatctttcactcaaaaattgttatcctaattgtcaaaaactatgtggagatctaagtgataaaaccactcagggttgggcagggacaggatttttctaactctttttcctttcatcacaacgggtagtatattttatattaaaagcagaagctcactatatgctggtgtttaatgcattggtgaaaatcagtaatttttctatgttagataataagtatgcaattaacatatttttaatttatagcaggtttctggatggcagatcattcaaccttctttttcttgagttttctactctgctgtcatcttccactcatttctgcttcattttgtgattcgttaacagaaaaggaagtggaatggaataaaatcccccaatacagtacaattatacattaatggctgtaatgtgaagagcatcacacacgaagagagccatcttccagaaataagtttatacactctctcctctaattgcatcaggactttaccagataatgttcttccagatctgaaaaggaaaatgcctaaaagagcttccaaactcatttttgaataatactaggctacaaagaattacactgtgaattcattaagggtaacaccaaatcactaaacagcactgtttgtacagaaatgtcgaaaagctgtggaaataatttagcggccatttctgtaggaatttcgcttcttttactcttagtggtttgtggaattgggtgtgtttggcactggaaacaccgtgttgccacacgatttaccttaccgaggtttttacaaaggagaagcagcaggagaaaagtctgtactaaaacattcttgggcccccgcatcattggcttaaggcatgaaatctcagttgaaacccaagaccacaaatctgctgtcaggggaaataacacacacgacaactatgaaaatgtggaagcaggtcctcccaaagctaaaggaaaaaccgataaggaactatatgaaaacacagggcagtctaatttcgaggagcatatctatggaaatgagacatcttctgactattataacttccagaagcctcgtccttctgaagttcctcaagatgaagatatatacattcttccagattcatattagcttttcaaaatattgacttttgttattggatgataaatattcactgtaatttttcaacagcaaagacaaggaatcaaactaaatgttgatcaactgtagactggataaagaaaatgtggtacacatacaccatagaatattatgcagccgtaaaaaaagaacaaaactaacatgggaacagaaaatcaaataccacatattctcacttaaaagtgggagctaaataataagaacacatggagagaaggagaggaacaacagacactggggcctacttgagggaggacagtggaaggagggagaggttcagggaaaaaaaaaatatcaggtactatgcttagtacacacatgatgaaataatctgtacaccaaacccccaagtcacaagtgttcctacataacaaacctgaacatgtacccctgaacataaaattataattaaaatattaaaaataattcactgtgatttttattgtactgatgccattcttaatcaagttctgataagtggatggtctctgcctatctccacctttctgaatcctatgtgtatcgctgtggattaattctagatatcttctccaccctccttgcaccagactaaatctgtattatgtgatattgattcttccttctaaatattacccgttatctctttcctttatttctaccattatctttatctggctcagaattattgtcataggctcctaactgttcctcctgcttctagtttctacccactcaatcaattaccgatggtgttgccagatttatcttcagaaaatattcctaacagccacattatttctttcacttaaaatgttttaatgccccctctttgcaaaagacataatacccataatttgaactccaaaatttatggttttccacaattggttccaattcacttttccagtgacttctcttactatctctcatttctttgccttcagcagaatcatcttaaaacctgccaaacttatccttccttcacagctttgcttttctgcctcttctctcaagcctgcttcagatcataagttcttccacacatctcctgaatcactccaaacccgcatttacctttttattttctgatataagctttgatgcctcttcaattcttaggacatttaaacatatgaatgttgccacagcattttattacctagcttcatatgaaaatgtcttaaattcccacctaaatgaaaagaaactgcccaaatgcctagaacatcacataaggcactaaatgcctcatgttttactgacgggaattgaattgtacattttgctgagtagttttgagaaaaaaatctaataaattcatctgttattcatccata

SEQ ID NO: 72636 - DNA, 2436 bp, Homo sapiens
aagtaacccaccaaagtgaaaaagaggaacaagttctaacccaatgcaggtttaaaacataaccaaaagaacaaaagagagagcttgacacaccaatcttgaggtgttgtgccattctctgggaacatacagatgaaatgacctgaaccctgcccaccatttaaccaagtaagaatacaattctctctcatttaggttatcacgctataatagagaatggactcattaatatgggattacagaggaaggaatggttaagaaaaagacatggcctctgactgctccaaaaaaggataagcagggcttcacagaagaggtgacagaaaaggaagtggaatggaataaaatcccccaatacagtacaattatacattaatggctgtaatgtgaagagcatcacacacgaagagagccatcttccagaaataagtttatacactctctcctctaattgcatcaggactttaccagataatgttcttccagatctgaaaaggaaaatgcctaaaagagcttccaaactcatttttgaataatactaggctacaaagaattacactgtgaattcattaagggtaacaccaaatcactaaacagcactgtttgtacagaaatgtcgaaaagctgtggaaataatttagcggccatttctgtaggaatttcgcttcttttactcttagtggtttgtggaattgggtgtgtttggcactggaaacaccgtgttgccacacgatttaccttaccgaggtttttacaaaggagaagcagcaggagaaaagtctgtactaaaacattcttgggcccccgcatcattggcttaaggcatgaaatctcagttgaaacccaagaccacaaatctgctgtcaggggaaataacacacacgacaactatgaaaatgtggaagcaggtcctcccaaagctaaaggaaaaaccgataaggaactatatgaaaacacagggcagtctaatttcgaggagcatatctatggaaatgagacatcttctgactattataacttccagaagcctcgtccttctgaagttcctcaagatgaagatatatacattcttccagattcatattagcttttcaaaatattgacttttgttattggatgataaatattcactgtaatttttcaacagcaaagacaaggaatcaaactaaatgttgatcaactgtagactggataaagaaaatgtggtacacatacaccatagaatattatgcagccgtaaaaaaagaacaaaactaacatgggaacagaaaatcaaataccacatattctcacttaaaagtgggagctaaataataagaacacatggagagaaggagaggaacaacagacactggggcctacttgagggaggacagtggaaggagggagaggttcagggaaaaaaaaaatatcaggtactatgcttagtacacacatgatgaaataatctgtacaccaaacccccaagtcacaagtgttcctacataacaaacctgaacatgtacccctgaacataaaattataattaaaatattaaaaataattcactgtgatttttattgtactgatgccattcttaatcaagttctgataagtggatggtctctgcctatctccacctttctgaatcctatgtgtatcgctgtggattaattctagatatcttctccaccctccttgcaccagactaaatctgtattatgtgatattgattcttccttctaaatattacccgttatctctttcctttatttctaccattatctttatctggctcagaattattgtcataggctcctaactgttcctcctgcttctagtttctacccactcaatcaattaccgatggtgttgccagatttatcttcagaaaatattcctaacagccacattatttctttcacttaaaatgttttaatgccccctctttgcaaaagacataatacccataatttgaactccaaaatttatggttttccacaattggttccaattcacttttccagtgacttctcttactatctctcatttctttgccttcagcagaatcatcttaaaacctgccaaacttatccttccttcacagctttgcttttctgcctcttctctcaagcctgcttcagatcataagttcttccacacatctcctgaatcactccaaacccgcatttacctttttattttctgatataagctttgatgcctcttcaattcttaggacatttaaacatatgaatgttgccacagcattttattacctagcttcatatgaaaatgtcttaaattcccacctaaatgaaaagaaactgcccaaatgcctagaacatcacataaggcactaaatgcctcatgttttactgacgggaattgaattgtacattttgctgagtagttttgagaaaaaaatctaataaattcatctgttattcatccata

SEQ ID NO: 72637 - DNA, 2393 bp, Homo sapiens
aagtaacccaccaaagtgaaaaagaggaacaagttctaacccaatgcaggtttaaaacataaccaaaagaacaaaagagagagcttgacacaccaatcttgaggttatcacgctataatagagaatggactcattaatatgggattacagaggaaggaatggttaagaaaaagacatggcctctgactgctccaaaaaaggataagcagggcttcacagaagaggtgacagcaggtttctggatggcagatcattcaaccttctttttcttgagttttctactctgctgtcatcttccactcatttctgcttcattttgtgattcgttaacagaaaaggaagtggaatggaataaaatcccccaatacagtacaattatacattaatggctgtaatgtgaagagcatcacacacgaagagagccatcttccagaaataagtttatacactctctcctctaattgcatcaggactttaccagataatgttcttccagatctgaaaaggaaaatgcactgtgaattcattaagggtaacaccaaatcactaaacagcactgtttgtacagaaatgtcgaaaagctgtggaaataatttagcggccatttctgtaggaatttcgcttcttttactcttagtggtttgtggaattgggtgtgtttggcactggaaacaccgtgttgccacacgatttaccttaccgaggtttttacaaaggagaagcagcaggagaaaagtctgtactaaaacattcttgggcccccgcatcattggcttaaggcatgaaatctcagttgaaacccaagaccacaaatctgctgtcaggggaaataacacacacgacaactatgaaaatgtggaagcaggtcctcccaaagctaaaggaaaaaccgataaggaactatatgaaaacacagggcagtctaatttcgaggagcatatctatggaaatgagacatcttctgactattataacttccagaagcctcgtccttctgaagttcctcaagatgaagatatatacattcttccagattcatattagcttttcaaaatattgacttttgttattggatgataaatattcactgtaatttttcaacagcaaagacaaggaatcaaactaaatgttgatcaactgtagactggataaagaaaatgtggtacacatacaccatagaatattatgcagccgtaaaaaaagaacaaaactaacatgggaacagaaaatcaaataccacatattctcacttaaaagtgggagctaaataataagaacacatggagagaaggagaggaacaacagacactggggcctacttgagggaggacagtggaaggagggagaggttcagggaaaaaaaaaatatcaggtactatgcttagtacacacatgatgaaataatctgtacaccaaacccccaagtcacaagtgttcctacataacaaacctgaacatgtacccctgaacataaaattataattaaaatattaaaaataattcactgtgatttttattgtactgatgccattcttaatcaagttctgataagtggatggtctctgcctatctccacctttctgaatcctatgtgtatcgctgtggattaattctagatatcttctccaccctccttgcaccagactaaatctgtattatgtgatattgattcttccttctaaatattacccgttatctctttcctttatttctaccattatctttatctggctcagaattattgtcataggctcctaactgttcctcctgcttctagtttctacccactcaatcaattaccgatggtgttgccagatttatcttcagaaaatattcctaacagccacattatttctttcacttaaaatgttttaatgccccctctttgcaaaagacataatacccataatttgaactccaaaatttatggttttccacaattggttccaattcacttttccagtgacttctcttactatctctcatttctttgccttcagcagaatcatcttaaaacctgccaaacttatccttccttcacagctttgcttttctgcctcttctctcaagcctgcttcagatcataagttcttccacacatctcctgaatcactccaaacccgcatttacctttttattttctgatataagctttgatgcctcttcaattcttaggacatttaaacatatgaatgttgccacagcattttattacctagcttcatatgaaaatgtcttaaattcccacctaaatgaaaagaaactgcccaaatgcctagaacatcacataaggcactaaatgcctcatgttttactgacgggaattgaattgtacattttgctgagtagttttgagaaaaaaatctaataaattcatctgttattcatccata

SEQ ID NO: 72638 - DNA, 2290 bp, Homo sapiens
aagtaacccaccaaagtgaaaaagaggaacaagttctaacccaatgcaggtttaaaacataaccaaaagaacaaaagagagagcttgacacaccaatcttgaggttatcacgctataatagagaatggactcattaatatgggattacagaggaaggaatggttaagaaaaagacatggcctctgactgctccaaaaaaggataagcagggcttcacagaagaggtgacagaaaaggaagtggaatggaataaaatcccccaatacagtacaattatacattaatggctgtaatgtgaagagcatcacacacgaagagagccatcttccagaaataagtttatacactctctcctctaattgcatcaggactttaccagataatgttcttccagatctgaaaaggaaaatgcctaaaagagcttccaaactcatttttgaataatactaggctacaaagaattacactgtgaattcattaagggtaacaccaaatcactaaacagcactgtttgtacagaaatgtcgaaaagctgtggaaataatttagcggccatttctgtaggaatttcgcttcttttactcttagtggtttgtggaattgggtgtgtttggcactggaaacaccgtgttgccacacgatttaccttaccgaggtttttacaaaggagaagcagcaggagaaaagtctgtactaaccaagaccacaaatctgctgtcaggggaaataacacacacgacaactatgaaaatgtggaagcaggtcctcccaaagctaaaggaaaaaccgataaggaactatatgaaaacacagggcagtctaatttcgaggagcatatctatggaaatgagacatcttctgactattataacttccagaagcctcgtccttctgaagttcctcaagatgaagatatatacattcttccagattcatattagcttttcaaaatattgacttttgttattggatgataaatattcactgtaatttttcaacagcaaagacaaggaatcaaactaaatgttgatcaactgtagactggataaagaaaatgtggtacacatacaccatagaatattatgcagccgtaaaaaaagaacaaaactaacatgggaacagaaaatcaaataccacatattctcacttaaaagtgggagctaaataataagaacacatggagagaaggagaggaacaacagacactggggcctacttgagggaggacagtggaaggagggagaggttcagggaaaaaaaaaatatcaggtactatgcttagtacacacatgatgaaataatctgtacaccaaacccccaagtcacaagtgttcctacataacaaacctgaacatgtacccctgaacataaaattataattaaaatattaaaaataattcactgtgatttttattgtactgatgccattcttaatcaagttctgataagtggatggtctctgcctatctccacctttctgaatcctatgtgtatcgctgtggattaattctagatatcttctccaccctccttgcaccagactaaatctgtattatgtgatattgattcttccttctaaatattacccgttatctctttcctttatttctaccattatctttatctggctcagaattattgtcataggctcctaactgttcctcctgcttctagtttctacccactcaatcaattaccgatggtgttgccagatttatcttcagaaaatattcctaacagccacattatttctttcacttaaaatgttttaatgccccctctttgcaaaagacataatacccataatttgaactccaaaatttatggttttccacaattggttccaattcacttttccagtgacttctcttactatctctcatttctttgccttcagcagaatcatcttaaaacctgccaaacttatccttccttcacagctttgcttttctgcctcttctctcaagcctgcttcagatcataagttcttccacacatctcctgaatcactccaaacccgcatttacctttttattttctgatataagctttgatgcctcttcaattcttaggacatttaaacatatgaatgttgccacagcattttattacctagcttcatatgaaaatgtcttaaattcccacctaaatgaaaagaaactgcccaaatgcctagaacatcacataaggcactaaatgcctcatgttttactgacgggaattgaattgtacattttgctgagtagttttgagaaaaaaatctaataaattcatctgttattcatccata

SEQ ID NO: 72639 - DNA, 693 bp, Homo sapiens
aagtaacccaccaaagtgaaaaagaggaacaagttctaacccaatgcaggtttaaaacataaccaaaagaacaaaagagagagcttgacacaccaatcttgaggtgttgtgccattctctgggaacatacagatgaaatgacctgaaccctgcccaccatttaaccaagtaagaatacaattctctctcatttaggttatcacgctataatagagaatggactcattaatatgggattacagaggaaggaatggttaagaaaaagacatggcctctgactgctccaaaaaaggataagcagggcttcacagaagaggtgacaggaatttattgccatgtggtttactccagcatcactggttgtttgcagctttctagtttcttccatcattcccaggaccagcttctctgcaacctgtcagaagcaccagcaccagccaggtggcaccctcccttagactctgacagccagactctccttcaacctcctgaagtggtgcaggagacaagtggtaccctcagagttctgcgtcccagcctggcagggctcctcctctgaggtctggtaactctcagccaagattgttacagttactatctctgtggtacctgtgtccccttttttgtttttccatcctgccaatgcctgtttagccaattatctatattaaattctctctgttaaaacaaatt

SEQ ID NO: 72640 - DNA, 2281 bp, Homo sapiens
aagtaacccaccaaagtgaaaaagaggaacaagttctaacccaatgcaggtttaaaacataaccaaaagaacaaaagagagagcttgacacaccaatcttgaggtgttgtgccattctctgggaacatacagatgaaatgacctgaaccctgcccaccatttaaccaaaaaaggaagtggaatggaataaaatcccccaatacagtacaattatacattaatggctgtaatgtgaagagcatcacacacgaagagagccatcttccagaaataagtttatacactctctcctctaattgcatcaggactttaccagataatgttcttccagatctgaaaaggaaaatgcctaaaagagcttccaaactcatttttgaataatactaggctacaaagaattacactgtgaattcattaagggtaacaccaaatcactaaacagcactgtttgtacagaaatgtcgaaaagctgtggaaataatttagcggccatttctgtaggaatttcgcttcttttactcttagtggtttgtggaattgggtgtgtttggcactggaaacaccgtgttgccacacgatttaccttaccgaggtttttacaaaggagaagcagcaggagaaaagtctgtactaaaacattcttgggcccccgcatcattggcttaaggcatgaaatctcagttgaaacccaagaccacaaatctgctgtcaggggaaataacacacacgacaactatgaaaatgtggaagcaggtcctcccaaagctaaaggaaaaaccgataaggaactatatgaaaacacagggcagtctaatttcgaggagcatatctatggaaatgagacatcttctgactattataacttccagaagcctcgtccttctgaagttcctcaagatgaagatatatacattcttccagattcatattagcttttcaaaatattgacttttgttattggatgataaatattcactgtaatttttcaacagcaaagacaaggaatcaaactaaatgttgatcaactgtagactggataaagaaaatgtggtacacatacaccatagaatattatgcagccgtaaaaaaagaacaaaactaacatgggaacagaaaatcaaataccacatattctcacttaaaagtgggagctaaataataagaacacatggagagaaggagaggaacaacagacactggggcctacttgagggaggacagtggaaggagggagaggttcagggaaaaaaaaaatatcaggtactatgcttagtacacacatgatgaaataatctgtacaccaaacccccaagtcacaagtgttcctacataacaaacctgaacatgtacccctgaacataaaattataattaaaatattaaaaataattcactgtgatttttattgtactgatgccattcttaatcaagttctgataagtggatggtctctgcctatctccacctttctgaatcctatgtgtatcgctgtggattaattctagatatcttctccaccctccttgcaccagactaaatctgtattatgtgatattgattcttccttctaaatattacccgttatctctttcctttatttctaccattatctttatctggctcagaattattgtcataggctcctaactgttcctcctgcttctagtttctacccactcaatcaattaccgatggtgttgccagatttatcttcagaaaatattcctaacagccacattatttctttcacttaaaatgttttaatgccccctctttgcaaaagacataatacccataatttgaactccaaaatttatggttttccacaattggttccaattcacttttccagtgacttctcttactatctctcatttctttgccttcagcagaatcatcttaaaacctgccaaacttatccttccttcacagctttgcttttctgcctcttctctcaagcctgcttcagatcataagttcttccacacatctcctgaatcactccaaacccgcatttacctttttattttctgatataagctttgatgcctcttcaattcttaggacatttaaacatatgaatgttgccacagcattttattacctagcttcatatgaaaatgtcttaaattcccacctaaatgaaaagaaactgcccaaatgcctagaacatcacataaggcactaaatgcctcatgttttactgacgggaattgaattgtacattttgctgagtagttttgagaaaaaaatctaataaattcatctgttattcatccata

SEQ ID NO: 72641 - DNA, 1381 bp, Homo sapiens
aagtaacccaccaaagtgaaaaagaggaacaagttctaacccaatgcaggtttaaaacataaccaaaagaacaaaagagagagcttgacacaccaatcttgaggtgttgtgccattctctgggaacatacagatgaaatgacctgaaccctgcccaccatttaaccaaaaaaggaagtggaatggaataaaatcccccaatacagtacaattatacattaatggctgtaatgtgaagagcatcacacacgaagagagccatcttccagaaataagtttatacactctctcctctaattgcatcaggactttaccagataatgttcttccagatctgaaaaggaaaatgcctaaaagagcttccaaactcatttttgaataatactaggctacaaagaattacactgtgaattcattaagggtaacaccaaatcactaaacagcactgtttgtacagaaatgtcgaaaagctgtggaaataatttagcggccatttctgtaggaatttcgcttcttttactcttagtggtttgtggaattgggtgtgtttggcactggaaacaccgtgttgccacacgatttaccttaccgaggtttttacaaaggagaagcagcaggagaaaagtctgtactaaaacattcttgggcccccgcatcattggcttaaggcatgaaatctcagttgaaacccaagaccacaaatctgctgtcaggggaaataacacacacgacaactatgaaaatgtggaagcaggtcctcccaaagctaaaggaaaaaccgataaggaactatatgaaaacacagggcagtctaatttcgaggagcatatctatggaaatgagacatcttctgactattataacttccagaagcctcgtccttctgaagttcctcaagatgaagatatatacattcttccagattcatattagcttttcaaaatattgacttttgttattggatgataaatattcactgtaatttttcaacagcaaagacaaggaatcaaactaaatgttgatcaactgtagactggataaagaaaatgtggtacacatacaccatagaatattatgcagccgtaaaaaaagaacaaaactaacatgggaacagaaaatcaaataccacatattctcacttaaaagtgggagctaaataataagaacacatggagagaaggagaggaacaacagacactggggcctacttgagggaggacagtggaaggagggagaggttcagggaaaaaaaaaatatcaggtactatgcttagtacacacatgatgaaataatctgtacaccaaacccccaagtcacaagtgttcctacataacaaacctgaacatgtacccctgaacataaaattataattaaaatatta

SEQ ID NO: 72642 - DNA, 393 bp, Homo sapiens
tccgcgtcttctgcagactaatcaaaccactcatggaaccaaagaatgaggaaaaggcagatggtatcccagaaaggtgtcttctccaacagccagatacttttcatcagaacagaggctggtgtgccgctggctctgggctcctccacacccacagggcagcaccactgtctccagtgcacactgcacagaagcagctctgggtgctttggtcaataacccatcttcgtggctcgtggatatttcttgttagtcttaggcttccatcgtgacctttctgagtgcccctcaatctcattaactcccctttcaaggctctgtccccagaaaacaagcttcaggttgtgaccctgtttcctcacattcatttctgatacacgtatctggagaatt

SEQ ID NO: 72643 - DNA, 404 bp, Homo sapiens
gggcggtgctgctaaggattgaggtcgagtgtcaagcttgagctcttcagtcaatgctagaaatggacgtttagttattgaatcccgctaacgaggggagccaacaagagagggatgtcggcatcgggtgtgcggttccaagaactgattggctgtggagattagaagttaggtgaaaattctcttaaactcgggcaaacgaattgatgatttttcccctggtcggtgttagagacacagtaaatgcttaaccatctcgctagacagctcaactgaagtggcattaacttcccgggaaagtgtgtagaaaggcatttttaaatactgtaaactcgaacgtaaatatcttttaatgtggaactgttactacatttaacactgaacatcttttcaacttttacata

SEQ ID NO: 72644 - DNA, 209 bp, Homo sapiens
gggcggtgctgctaaggattgaggtcgagtgtcaagcttgagctcttcagtcaatgctagaaatggacgtttagttattgaatcccgctaacgaggggagccaacaagagagggatgtcggcatcgggtgtgcggttccaagaactgattggctgtggagattagaagttaggaacctttgcaacggaaagcggcctcgggcaggcgcc

SEQ ID NO: 72645 - DNA, 321 bp, Homo sapiens
gggtgagaaggcaccggtgccactagtccctgacctgtccctcagacaagttacaaatgaagactgagggggtggagtagctatggaaaccaggagggaaggatttttttttttaatgcaaatgaattagaacaaaatgactggcatccctttttctttttccatctgtgacaaaaattctgtgtcctggtttctaccttcacttggagtaaattatgggggaaagaacatcatgaagacctgctattgtcagagtgtcatttcctctttctatctttctgtggattaattttaaatccatttgatagaattaatcatata

SEQ ID NO: 72646 - DNA, 296 bp, Homo sapiens
taagagacagggtctcactctctttcccaggctggagtgcagtggcaacgatcatagctcactgcatcctcgaactcctggccccaagggatcctcccactttggcctcccaaagcactgagattgcaggcgtgagacacctcacctggcttgtctgagaacatcttttaaaaaaatcccttctcttgggttttctgttacccatatgtctactcaatttggttgtctcagctttgttgttgtaatgcaaaagcagccatagacaatacatgcatgaatgagtgtagtgcattcca

SEQ ID NO: 72647 - DNA, 821 bp, Homo sapiens
aaaattaaaattcagtagttaaactcttcataatgcagaaatggatggcttgattgtatagaaaaatgagtctttcagttacaccattcttgaaaataatagtgtatgtttgaaatttgtcattaattagttgcttttgaaggcaatctatttgaaatatgtaatttcctgatgttatctgcattgtgttaagaaaaaaataataggctataaaatcaatttttgtaaaaaaaatgtacagttttaagttgtgtacagaaaaaggaagagcgtacacagtcttagagtggaatatacctctagtacagtgtatgtgttaattccaactcaagcaaagaaatgagtatttaccatctttcctataacatgtaaatgtattattcctgttctacagacactgtatatttatgaccttatttggacattattagacactggtttcttagtaaagcacagtaacttggatcagattctttgtaaccgaaacacttaaacatgtattagtaataccaatatatttagattttatatttttataatttagcttctatgcattacagaagttgaattaagaaatttaagtcatcaccatatttttgttttctttaccacttgggaaaataatcctctttgaggcagtaacactatgtatgtactgttaataggccagaaagaaatattggcagttgtcttaggtaagcaataaaaacatctccaatttactgaaagttcagaaatataactcttacatgctggcagggtaccattagtcatctatacccaccatattccctcatctttcagtccattctggctattat

SEQ ID NO: 72648 - DNA, 597 bp, Homo sapiens
tgacagaatctcactctgttgcccaggctggagtacagtggcgcggtcttggctcactgcaacctccgcctcctgggttcaagtgattctcctgcctcagcctcctgagtagctgggactacgggcatgtgccaccacacctggctaatttttgtatttttagtagagacggggtttcactatgttgaccaggctggacttgaattcctgacctcgtgatctgcccaccttggcctcctaaagtgctgggattacaggcgtgagccactgggcgcagccaactcttccatttcttaaaccccttcttcatcccctctctgtcttcactccattctccttctgttataaatcccaaagtatgttcagctatttattccatcctattttttgccttttctgtttggcctcctaaattctaccatgcagcctaccgatcaccacccaccttctctgtgtctcaagattccaccccctccatgtattttttttcttttctcatactgccttatctttctccttgtgtatcccaggaggtcaggatggtgggggaacggcatgctggggacctcatggtgcccttagggcctcggctgcagg

SEQ ID NO: 72649 - DNA, 761 bp, Homo sapiens
ggaccggccgctgggtcccagcgagggctgagccgggcggtgggaggaggtcaggatggtgggggaacggcatgctggggacctcatggtgcccttagggcctcggctgcaggcatatcctgaagaactcattcgacagaggcctgggcatgacgggcatcctgaatacctgatccgatggagtgtcctgaagtgtggggaagtgggcaaagtgggtgtggaagaaggcaaagcagagcacatcctcatgtggctgtcggctcctgaggtctacgccaactgccctgggctgttaggtgagcgggcactatctaagggacttcagcacgaaccagctggggtttcaggaagctttcctcgagatccaggaggcctggatgaagtggcaatgggagagatggaggctgatgttcaggcgctggtacgcagggcggccaggcagctggcagaaagtgggaccccaagcctcacggccgctgtgcttcacaccatccacgtgctcagtgcctacgccagcatcgggcccctcactggtgtcttcagggagacaggagccctggacctgctcatgcacatgttatgcaatcctgagcctcagatccgccggagtgcaggcaaaatgctgcaggctctggcagcccacgatgctgggagtcgggctcacgtccttctatcactgagccagcaagatggcatcgagcaggcacatggattttgaccagtcgctaacattgctgggagctgtttgcagaaaccacatc

SEQ ID NO: 72650 - DNA, 905 bp, Homo sapiens
actcctgagtagttgtgattacaggtgtgccaccacgccaggctaatttttgtatttttagtagagatggggtttcaccatgttggccaggctggtctcaaactcctgacctcaggtgatctggctgcctgagtctcccaaagtgctggcattacaggtgtgagccactgcactcggcagaaggttacttttgtagatggggtctcactatgttgccaggctggtctcaaactcctgggctcgagcagtcctcccacctggacctcccaaagtgctgggattaccagcatgagccactgtgtctggcctaaatatatatatttaaataattagaatcatacatttccaagacccccaatatgaacagaagctctgcagaaaacagtttgaaaaccaggcatccagcagggagaacctgggcttcccatcacccgctttttcattcccaccctagctccctcatgctccacaacttggggacaagttagttgttttctctgagccttctttttcccttctgcggggataatcttacttgacttccctgaccacaagagacttgcctgggaacatgcatggaaagctctgtgatgagccctgagatgtttgaagtgagaactctccaaacagccactgtgggcataatctggaaaattccctcaggtgtaacgctcctctgcccagcaagtgaacaaagggctgactggtgacagtttctggacactgtcgcaggctatttaagcctgcaagcaagcatcaacacagagtagggtctagggctgggcacagtggctcatgcctgtaatcccagcaatttgggaggccaaggcaggaggattgcttaaggctgggagttcaagaccagcctgggcaacatagtgagaccccatctctaaaaaaaaaaa

SEQ ID NO: 72651 - DNA, 300 bp, Homo sapiens
ccttggcctcccaaagtgctgggattacaggcgtgagccactgcgcctggccaacactatcctgtattaagcaccaggtttgtggtcagtccttggatctggttgctaattttttttgtctcttgttcaaaatcctggtttataaaatttgttgcatgtgtgcttaataaactagcactaagtgttgaagtggaaatctctttttttttttttttttttttgagacggagtctcgcccttgtcacccagcctggagtgcaatggcgtgatctcggctcactgcaacctccgtctcccggg

SEQ ID NO: 72652 - DNA, 391 bp, Homo sapiens
  misc_feature (277)..(277): n is a, c, g, or t
tgatgtgtttccaaaacttgtgggaagcccaagtacatagttcatatacagctcactatgaactatcacctgtgacctcacagtcttctgaccccttggcctttctctctcctcatcctcttcatctttccctgatttcccctgaaccttccagaagggccttctggctcagaaccagacccctgcctgggttactccgtctgcccttctgcctgattaggagcaaggggtctcgcacaggctgggacaatgcccaaggtctgtgctgaggcacaanaacaagggccatgtgagggagggggcaggggtttctggggatgctggtcattaatggataacagcctggaacttatatccatggaccttttaaaaacatctttttactgagggg

SEQ ID NO: 72653 - DNA, 447 bp, Homo sapiens
aggtctcattcagttttaatattgtaatttattccaattaacaacatggatcttaaacaggccagcctgataagctctctggttcctcattctggttagtattggtacagttttcagaaatatcaaaaaatttcaagtatcaacataggcagatcacattcagtttttaaacaaaagcaattatgttaggttgaaaaatatagtctgtttttacaatattagaattgaagatctggacatttgtttaaaggatatcagcacattacaggtaattttcattctattttactctttagagtttcaacaagtgtgagataaattacattaacactaaattttgcatttgttggagggaaatagatgctggattattttaaggatattgagagttcacaaaaatagcaatataaatggacctaaataaaatatgcatatactgcagagtga

SEQ ID NO: 72654 - DNA, 167 bp, Homo sapiens
ctggaataatttcttatatacagcagagttagcgttgtggtgttcttcctgagaattctcagacagtatgtcttaacagcagtcattttctttatttagagtgctgtttagtttactaatagtgattctttcaaaatcactgtgcactcaacattactcgtgaaatg

SEQ ID NO: 72655 - DNA, 389 bp, Homo sapiens
gaataaaacttaataatgaaagataataattttgctccagacaggtttcttcactgtaagcatcagatactcacagagtatgtagaaaatatgtgtccggccgggcgcggtggctcacgcctgtaatcccagcactttgggaggccgaggcgggtggatcatgaggtcaggagatcgagaccatcctggctaacaaggtgagaccccgtctctactaaaaatacaaaaaaaaattagccgggcgcggtggcgggcgcctgtagtcccagctactcgggaggctgaggcaggagaatggcgggaacccgggaagcggagcttgcagtgagccgagattgcgccactgcagtccgcagtccggcctgggcgacagagcgagactccgtctc

SEQ ID NO: 72656 - DNA, 406 bp, Homo sapiens
tgccctaaagtgacaccaaggttttgaagagtagagaactgaggaaatgtggtctatttgtctttgatagtaaactgcaatttgttatccaagcccagcttttgcgaagaaagtgatagatgattactccaataacagcctcaaaaagttttagtaggcctggtgtggtggctcacacctgtaatcccagcactttgggaggctgaggtgggaggattgcttgaggtcaggagtttgagaccagcctggccaacatagtgaaaccccgtctctactaaaaatacaaaaattagctaggtatggtggtgtgcccctgtaatcccagctacttgggaggctgaggctaggataattgcttgaacccgggaggcggaggttgcagtgagccaagatggcaccactgcac

SEQ ID NO: 72657 - DNA, 332 bp, Homo sapiens
tttatcttggtaagaggctcactcagtaagaggcacatgggaaaactgaaacccttaaaagtgattcaggcaggtccattgactcaagatctctctaggcacatgcctattgcccattgaggtgtgaattacctccatgggttaaattgttgatgtagtttctgttaaatatagaatatgactctgaatgactattctccttgctcaggggatggaaaatgattaaaacaaaatgcctgctctgaatgcaattaaaccagggaaaataagaccagaacaaaaatgatcataacgcaaaatatgacagaagtagtttcagaagaatgatgcat

SEQ ID NO: 72658 - DNA, 354 bp, Homo sapiens
cagctcactgcaacctccacctcacaggttcaagtgattccttgcctcagcttcccaagtagctgggactaccggtgcacaccaccatgtccagctaatttttgtattttttattagagacagggtttcactatatgttggccaggctggtctcaaactcctgacctcaagtgatccgcccacctcggcgtcccaaaatgctgggattacaggtgtgagccaccatgcccggcctaaattatagctattttagaatgttgaaagtagtattatgtgatttcagtttgccataaatttttcatatggttactaattatttcttttttgtgatatatcttctgaaatctattgagt

SEQ ID NO: 72659 - DNA, 379 bp, Homo sapiens
acggagtctcgctccgtcaccaggctggtgtgcagtggcgcgatctcggctcactgcaacctccgcttcccaggttcgagcaattctcctgcctcagcctcccgagtagctgggattacaggcccatgccaccacgcccagctaatttttctatttttagtagagacgaggtttcaccatgttggtcaggctggtctcgatctcatgacctcatggatccacccgcctcagcctcccaaagtgctgggattacaggcatgagccactgtgcccggcccgtaacccaattcttaaacagctttattaacatataattcacatgccacaaaattcagtcatttaaagtatacagtttaatgtatttaatatattcacagag

SEQ ID NO: 72660 - DNA, 280 bp, Homo sapiens
ctggtctgaaataactagaccagtggttctcaactggggccatttggccacatctggtgctgctgatatccagtgggtggaggccagggaggcccataaacacctaagacagtgcacatgccagccctctacccagcatgccagtggtgccaaggttcagaaaccctgaattccatgctatctcatgacacatcagttctaaacacattgactggttttaccccattggcagtttctgtttacacccaggtctgtgggcatatggaaaatcacggctgtt

SEQ ID NO: 72661 - DNA, 444 bp, Homo sapiens
tgagcctgatgtttggagcactaactggtggcctaagtaagagtcatgacattagacccatatagagaaggaagtgtaattctagcacacaagtttgcttagtacaatatttgcctgaacaatatttacatagtcataataatgtaacttttaaaagtggaggcaacaatagagtaactaaaaattaacagttaaaacaaaggttgcctctgaaggatggaataggggtaaggatgcataggatacaagattttacgatcatcagctctttctatacctgtgcagtccaaaacggtagccaccagccatgtgtgtggctccagagtacttgcaacgtagctagtcctaattgagatttgctgtcttctgaattgtgaagactttgtatttaaaaaaaaagaatgtaaaatagctcattaatcatttttaacgttgtttacatgt

SEQ ID NO: 72662 - DNA, 209 bp, Homo sapiens
gaaagaaaatcttaacagacctaaaaccaaaaaagaatcagaaattaaaagaaaaaaaacaactcccaataaagtacaggaacagattgtttctttactggtaaatcctaccaaacatttaaagaaaatttaacatcaactcttctaagacttttccagaaaattgaagaggaaggaatgcaacccaactcattctttgagtatcacta

SEQ ID NO: 72663 - DNA, 3177 bp, Homo sapiens
  misc_feature (1)..(1): n is a, c, g, or t
  misc_feature (2439)..(2439): n is a, c, g, or t
natttgggaagaaaaagaaaatgttggatcatttacaaatcgaatgaccccagaaaagcacttaaattctttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccctgtcccatctggggcccgagtgccaaccctttatttcatccacaccccaattccggcccacacctatggctcaggccgaggctcaggcccatcttcaatcttctttcccagtcctatctcctgcttttccatccctgattcagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcaggacgaatcaccagggacaagtcaggccaagggcaaacccagtccctggcagtcctccatgtccacaggtgaaagcagcaaggaggcacagaaggtgaagttccagctagagagggacccgtgcccacatctggggcaaattctgggtgagaccccacaaaatctatccagggatatgaaaagcttcccacggaaggttctgggggtgacttctgaggagttggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgcgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgaacccttgaagcctcctccagctggacaggagggcaggtggccatctaagcccctcacgtacagcctcacaggcagcacccagcagagcaggagcttaggagcccaatcttcaaaggctggagagacaagggaggcagtgccacaatgcagagtccccttggaaacctgtatgctggcaaacctccaagccacaagtgaggatgtgcatggtttcgaggctccagggaccagcaaaagctctctacaccctagagtgtctgtctcccaagatccaagaaagctgtgtcttatggaggaggttgttagtgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctactgggaacatgcgggcttcccaggagctacatgacctcatggcagccagaaggagcaaactggtgcacgaggagcccagaaaaccaaactgtcaaggctcatgcaagagccaaaggccaatgtttccccctattcacaagagtgagaagtttaggaagcccaacttagaaaaacatgaagaaaggcttgaaggattgaggactcctcaacttaccccagtcaggaaaacagaagacacccatcaggatgaaggcgtccagctactgcnatcaaagaaacagcctccttcagtaagcccctttggagaaaacatcaagcaaatttttcagtggattttttcaaagaaaaaaagcaagccagcaccagtcactgctgagagccaaaaaacagtaaaaaacagatcatgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacagacaaatcagaaatcaacagcccttgaaaagtgtgcggtgcaacaatgagcaatggggcctgcgacatccccaaatcttgcaccccaagaaagctgtatccccagtcagtccccctcagcactggccgaagacatccggtgcctctagccaccatcaccactgtccaaggcactgtcttctttgggaaggtatctgatttggtcagtcacaaattcttttttagccttccctggagaaaaacaagtccccaagaaaaaattcactctatgtagagaaaaaatattttctctcatgttagtacatgcagaacatttaatattccacaatatatatggttttttattc

SEQ ID NO: 72664 - DNA, 369 bp, Homo sapiens
atggattgccacagtaaggtaggaggagtacttctcctgaattatagtattgagatttgtatggcatattgaaaagcatcactcgttaaatattacgttgtagggacttttttgcattgtaaacatttgcgagtaaagggcaagttgaaagcttttttttaagatgctgtattatggagccacttcagaattttatatagagcaaaacaggccataaatgaataagtgaaatgaaataatattcagtgacctgtttccgtaagtcacaattaatttttgaaggtgattaaaatgcttactaagagccaggctggactcagtgctttacatatgatgcgtttgttttccccaccctcctttcagtttgga

SEQ ID NO: 72665 - DNA, 276 bp, Homo sapiens
tgagagttaggaagaatattctagactattagggataattctaagtatcttttagtgttcccatgtccagtgaaaaacgttaatgtaagacaaagcaaccccatatacacagtccatcaaaggttcttataccttagagttgcaagattcatccatcccaccaggtgaaaaaacccaaccagccaaggtgtttgtaaagaaaaataaaacatgaaatgcatagtcaaggaagggcattataagcaccaatggcctcatgaccaattgcagtactga

SEQ ID NO: 72666 - DNA, 424 bp, Homo sapiens
aataaaagtaaagtcaagcaaaccccccaaaattaaaatacatgtttgatatttaagctaaaatacttataggctgatttaaaggaatgatccctactttctttaaaatggagttatatatctatgtttatattctgtaacagatatgccattttagaaaatcagaagagatgtatggaactgataaccttagtccggagtggctaggttatcctttaaaaccaggatatatcttttttcttccttcctaaatattttgttattcagaaaaaaattcacagaaaaagaaaattatatttaactaagaggggatgttgtatgcccaagttctttagcatcgaagagggccgatggctgggaacgctggagagaggacagagcaaggtaaggaggctcttggtggaatgatgcttgtcctcagacc

SEQ ID NO: 72667 - DNA, 446 bp, Homo sapiens
tacatgtggacagacagagcagaatagtagacattggagacttcaaaaggtgggaggataggtgagagatgaaaaattacctattgggtaccatgtacactattcgggtgatgggtactctaaaagcccaggcttcaccactgcacagtatatccacgaaacaaaactgcacttgtaccccctgaatctataaaattaatacaaataaaaaagattgaaggcacctgtgctcttaaatcctttccagcctgggcaacagagccgagctccgtctgaaaaaaaaaaaaaaaagattagctgggcatggaggtgggcacctgtaatcccagctacttgggaggctgaggcaggagaatcgcttgaacctgggaggcagaggttgcagtgagctgagatggcgccatggcactctagcctgggtgacaagcaaaactccatctcaaaaa

SEQ ID NO: 72668 - DNA, 656 bp, Homo sapiens
aacagaacagaaagctctccctcttgtgtgaggcagttgctgtggaaaccccacgggcaggaggcccccggccagcacatcctgtctgcttgtgtctgctccacgagttctgggaccggggccatgtctccacacctcactgctctcctgggcctagtgctctgcctggcccagaccatccacacgcaggagggggcccttcccagaccctccatctcggctgagccaggcactgtgatctccccggggagccatgtgactttcatgtgccggggcccggttggggttcaaacattccgcctggagagggaggatagagccaagtacaaagatagttataatgtgtttcgacttggtccatctgagtcagaggccagattccacattgactcagtaagtgaaggaaatgccgggctttatcgctgcctctattataagccccctggatggtctgagcacagtgacttcctggagctgctggtgaaagggactgtgccaggcactgaagcctccggatttgatgcaccatgaatgaggagaaatggcctcccgtcttgtgaacttcaatggggagaaataattagaatgagcaatagaaatgcacagatgcctatacatacatatacaaataaaaagatacgattcgcaatggagaa

SEQ ID NO: 72669 - DNA, 209 bp, Homo sapiens
  misc_feature (28)..(28): n is a, c, g, or t
gtaggtctcgatgctctgcctggcccanaatccaacgcagggactgtgccaggcactgaagcctccggatttgatgcaccatgaatgaggagaaatggcctcccgtcttgtgaacttcaatggggagaaataattagaatgagcaatagaaatgcacagatgcctatacatacatatacaaataaaaagatacgattcgcaatggagaa

SEQ ID NO: 72670 - DNA, 707 bp, Homo sapiens
aacagaacagaaagctctccctcttgtgtgaggcagttgctgtggaaaccccacgggcaggaggcccccggccagcacatcctgtctgcttgtgtctgctccacgagttctgggaccggggccatgtctccacacctcactgctctcctgggcctagtgctctgcctggcccagaccatccacacgcaggagggggcccttcccagaccctccatctcggctgagccaggcactgtgatctccccggggagccatgtgactttcatgtgccggggcccggttggggttcaaacattccgcctggagagggaggatagagccaagtacaaagatagttataatgtgtttcgacttggtccatctgagtcagaggccagattccacattgactcagtaagtgaaggaaatgccgggctttatcgctgcctctattataagccccctggatggtctgagcacagtgacttcctggagctgctggtgaaagaaagctctggaggcccggactccccggacacagagcccggctcctcagctgggactgtgccaggcactgaagcctccggatttgatgcaccatgaatgaggagaaatggcctcccgtcttgtgaacttcaatggggagaaataattagaatgagcaatagaaatgcacagatgcctatacatacatatacaaataaaaagatacgattcgcaatggagaa

SEQ ID NO: 72671 - DNA, 247 bp, Homo sapiens
gccggatctggatctggctgggaaatcatgatgtggataacagtgtttttttgttgttgttttttgttttgaaacggagccttgctccatcacctaggctggagtgcagtagcgcaatcttggctgtctgcaacccttgcctctcgggttcaggagaattcctatagccagggagatggaggctgcagtgagctatgataatgccattgcactccagcctgggtgacagagtgagatcctgtctcca

SEQ ID NO: 72672 - DNA, 432 bp, Homo sapiens
gaaatgcagttttcccagtaccatttattaaagagactatcctttcccccattatgtcctcttgttacccttctcaaaaatcaattgaccgtatgtttggatttatttctgggctgtctattctgttgcactggtttatgtgcctgtttttctgccagagcatgctgttttaattactattgttttgtaacataattttgaatccagaattgtgatgcctacaactttgtttttcaaacagtaatttaaaaatattttggggacagctgcagtggcttacacctgtaatcccagcacttttggaggccaaagcaggagaatcgcttgagtccaggagttcaaaatcagcctgggctcttagggagacctgccttcacacacacaaaaattttattttaattagctgggcatggtgacacacacctgtagtcc

SEQ ID NO: 72673 - DNA, 552 bp, Homo sapiens
cctcccgagtagctgggactacaggcacccaccaccacgcccggctaatttttggtatttttaatagagtcagggtttcaccgtgttagccaggatggtctcgatctcctgacctcgtgatccgcccgcctcggcctcccaaagtgctgggattaccggcgtgagccaccgcgcccagcctatgagctatctttctaatgaggaagacaggcaaccactagggaaccaaataaatgcttgctgcaagttcaggtcaccttatgggctatgagggcaacaaagcagggtcagggagagagagtgctggggccacagcttcactggctggactcagggcatgcctcaccgaacacatcttatctagggcaggacccagaatgaagcgtgggaacaagtctgcatgtggtctgggctgaggcagtagcaagtgcagtgctgaggacgttccagcttggtgccctggagtgacagcaagctctatgtggctgcagcgacccaggcaagagggagagcagttggaagtgaggtcagtgcgccaatggggctttggag

SEQ ID NO: 72674 - DNA, 378 bp, Homo sapiens
tactagaggaccccatcgcgaatcactcaaattccaaaaacaatcattttttcattaatcaatggaggacccagcaattgaagtcttgtgtgtatttaatgtccaccgattttaaccttgttattactcaatttcactattttaacaccagacaataaccttctgagagctgcctcagaaaacacatcactctaaaataacttgattcaaattaaggttgtcttcttaggacagtggtttagtctcatgctgatattaaacagtacaggatttggagattcttgttctcacttataaacctcttaagattaagggttcagctttataactcttttaagtctttagcactcaacactgaacttgtactgggtcttcttg

SEQ ID NO: 72675 - DNA, 494 bp, Homo sapiens
ctgagacagagtccctgtcacccaggctggagagcagtggagcgatcttgactcactgcaacctgtgcctcccaggttcaagtgattctcgtgcctcagccttctgagtagctgagactacaggcgtgcactaccacacctggctaatttttgtatttttagttgagatggggttttgccatgttggccagggtggtctcgaactcctgacctcaggagatccacctgcctcggcttcccaaaatgctgggattacaggcatgagccaccacacctggccgtttcaccccatttgaaccttagttttctcctctgggaagccaaattaataaatgtttttatcacagggccgtcgttgaagcatgtatgactatgtgtgtgaaaatgttctgcaaaccaaaaagggctcaggtgctataattttttttctgcaaaggttgggctttgaaaggactttaattaaagattttaactgtaagatattcataacctaa

SEQ ID NO: 72676 - DNA, 715 bp, Homo sapiens
gagcagggggtgtggttggggacagtgtccagaggcttctttgaagctgacgcagggcctcacattggcatctctggaaatagtgaacacccagctccagagtggattagatgttagccacccctttataggggaggcctgagcaaatgtccctgagtgaatatcacttgcatctcccagagtaaaggcatctgacggcctcacttcagaggcttcctgcagtctgtccatgtttgattgtcattctcctcctctagcctgagtaccctggagatgtcacttttccttctcagaaaacactaagtaaggtgttccctgaggaggacccgagcccaccattggttctcttacccagggaagtgtctggccctctcctttgttctctgtctttaatctacttcctgtcttatgacaaagaaatctctgggagtttttaaactcaagaattattttaaaagtcacaagataacaaatgtcaagcccccaaaccacactgcctggaggactgcacatctgggagtgcctgggccgggccccagtgtccatgttggtgaaatagggagcggcgctcctctgaaggattgttcttgggactggcatgggccaggtcagtagcagtgctcagtacagtgctcacagaaggcagggagggacggattgctcccctcctttttcttcccctcagagtatgtatgttagttgagaaaaaaggaaa

SEQ ID NO: 72677 - DNA, 301 bp, Homo sapiens
caccctgaagtattagtcatcttcatattttatatactactcatgaatcgggggacgatattcactgtcattatcagcagaggaacttcctgtattgaaatctaagccacaagtggatccttctgtggctgtcaacatggataccattacactacaagtgcttcaccattaaatatcctgccaaagggctgtagcttcagaatattgaattttatcacatccaatagctcacaggttacaatagcaatcccacctttttagttattctttgtgcatctgttttatttctgtaccatagtcc

SEQ ID NO: 72678 - DNA, 370 bp, Homo sapiens
attagaaaattaatctgaccctcatgaaacaagctaccccaaaatactaagccacaaaaactggctttgcaagactgtcttccgcagctgtgatttttctttaaagtgcagcatctccttccgttaagttagaaggctttggtaaaagtgaccagtgacagaggtgttcaagggctctctttttaaaatctaggtaattgatactctcccccacgcttcaccccatggtgaagccatcacgttgctatctagctgtttgtcccgtctcccactcactagccccagaacagccttctcctgctgtgtccctcactcccctactttatgctctgtcatagcagctgttcaggacatcgcccgagcgcagcgg

SEQ ID NO: 72679 - DNA, 196 bp, Homo sapiens
caaacaagcaacttgaggacggattaggctagactctggcaagatgtagaaccttccagaactctggaggaatttgaaacaggcagagctgtgaggaaagcttttgggagcccactagagatctgcttttctgggtagagatagagaaggacccaggaatcacctgtgacctttgaagggctttgttgttcctggg

SEQ ID NO: 72680 - DNA, 377 bp, Homo sapiens
tgaaaaatttagttcataaagttttactagtagaacaaggacctgaatgaaggtggtggcagtaagaaacttggaaaacaaatgatacataacaaagactaaaactgctctccaacagtatattgtccactataaatcagatactatagaaataagaaatataaaaaaaacacttagccactagcatgcttctcaatcacatggaaattctagatctatctaatttaatctacagtttcaggaaatggattaatagatcttgatatgagacagctgctgacccctgtgaaaattaaaaacattttaaaagccctcttccttttttgttatctctaaaataaccagttttctaggaaaaaggaaaagagtaccatatt

SEQ ID NO: 72681 - DNA, 419 bp, Homo sapiens
agcttcatcttccttgggaggtacatttacaccagtttgaaagtctctgtgtctcattagtaccaatctcctgaacaactgtgagatttctcacataatttatgggtccctaatataatatttaattataagtagatatttaataaagaccaggaaacatatgagaaagcggcaagatttagacaccggcttctctgtcccaagaatcttctgtgtactgcattttccctaattaaaaatgagggtatttcaaccttccaaaatattgttgagtcccacagattattgaacaccttgagccttctggagaaaactacaaaaggcatgtgccttctcaaattccagcattttatcttacagatttagtttcagttattttgaagagcttagtttccctgtcacagggcatgctattagaa

SEQ ID NO: 72682 - DNA, 361 bp, Homo sapiens
tttaatcatgtcacagagtttattgtgtcatgtttgggggcctaggaatcatccacagaagcagaaaattgtgatgattagttttaggtgatctgcaaaacatcagatcagaaaatacacattttccacgcatctatcctcctacttactcacctatccacccatctaagtttaggtatcttgttctgtactagatacaagaggtctttaggatacagatcctgctcttcagatattcaaactttataaaagacaagacatgtaggtaaataataatgaaggcagaaagtggtactataaacgaaataaaaactaagtttgatgggggttgaggagtcattccaatctgaagggatacaga

SEQ ID NO: 72683 - DNA, 445 bp, Homo sapiens
ataataaaagggcttttattaagccctttggaaagaaaaaattgaggtaagttctagttaaaatttcatgagggaacaataatctccaagacttattactcttatagtgaaggcaactttaaagatgttttctcactttcttttaatcttttgctaacaaggcccactttttagtatcaaatattcatagcacttatagtgagtacatatattatagtactaataacttacagctaggaaaatatgaggataacttgtaagataagaaatcagagttaaaattttgtatgctatctcttaccattccccttctcaaacagaaaagaaaagaaaggttaaagaagaaggaagggaaaaggagcttgaggtgaaaaaagaaaagcataaaacacatgagttgacacttcaaacttaggctaacttttggtgagggatgtgtatatgt

SEQ ID NO: 72684 - DNA, 1008 bp, Homo sapiens
ctggctcctggtgcctctctatggagagcacctctgtgcctctctgagagcactcacagccaaaagtacacagctgcccccaggctgagagtgcttgatacacccttgaatcccctcttatatgatgccccagcccaggagagataaaagcatcagcaccatgagattcacctgcctctggtcgttagggaacaatggaggcctgcgatttggagttaaactctcagtgatctctgtgttgacaacaccaaagctagaggaatccagtaggatgtgggcatggttttcccggaaggctgactgagcagttctgcaaatgtttgcaagtacagggcagaatttcatccagcctcagaaccttgagccaagactcagcatcagcaaagccaaaagtttcatttcttcgactgtgggagtgctagtcccaacctttagatggccattcagttttaagttcaataagcattttgattgagaaatactttgctgaggagtgaaaagtccttggctttgaaagacgaatgatgagcagttcagtggcccatgtcacagtccaggcacctgccaaaggtgactccctgggaggagcatcttagtcacagagccagtgcctgctgtaggtgtgcagaagggtgcatgtgtgtgtgtgtgtgtgtgtgtgtatgtgtacgtgtacatgtgtgttgggggaagggagcaaggttgtgggagcatttcttatctgctcttctctgcaagatttcctgtgatttaagtcacattaaagtacccataagcccgtaatgcaaaagaaccccaaaaccagcccagcagccaaccatggcagcaagtagatgctctggtctttagatagtcagaaatgacacttctgggctctcaggcagtcagtgggttgagctccccattaaagtccccctgccaagtctggaatagtcctagtcccgtgtgtgtgtgtgtgtgtgtgtgtgtgtgtgtgtgtgtgtgtgtgtgtacccgcgtgcatatgcg

SEQ ID NO: 72685 - DNA, 2397 bp, Homo sapiens
ctaaaccaaattcaattaatgtaggtgcaaaaaatccaaaataaaactagcagtttgaattcagcattgtagcaaaagatatatcattttcaaggaagatttgtaccaaaacatgcaagattgagtgaagagtaactcactgtagctcactaaattaacagattaaagaagtatagtcatcttcacaagctgaaagagtatgtgataaattcaacatcctctggtattcttaacaatctcgaaatagaaggaaacttccttagcttagcttcttggcttcattaaatatacctaacagaaatccacaggaaacaaacttggtgaaaagtttttgctaagataaaaacggtactaaaaagtacacattttgggaaatgagacaaggctctcgttatttgtaaatatggggtctttttttttttggacaaaaaaccccctgtgatgatctactggcatgctattacagctaataaagctgaataaggaggctgtgcacaacaccaacacaccggtatgaaaagtgtgtacaccagcaataaccaattagaaaatgtatgaggaaatagactctcatccacaatagctgcgagaagtaaatattatctagaaataagattaacaagagaaatgtaaggcctatataaataaaaggataaatctatgctagagggtataaaagaaacacaaaaatagaggtatgccatgtataagacccaacataataaatagttctaccaaattaatttataaattcaaagcaatttcatataaccacagtaaagctttttaaatggatgtaataacctgattataacattaatctgaaagtcatcaggcataaagcaattttgattacatctcaaaacaatccatggagttagggtaaatgtgctgttcacacaggaataatcacaggtatagaaccgagaacctaggaacagagcaatgtatatatatatgtatttaaaaaatggcatcacaagtcagtagagaagggtttgaactattcagtaaatgatgttgaggttatttactactttttcttatttcatatcatggatgaaaaaaatcaagatgaattaaacatggaaattaaaaataactagaagaaaatactggaaaaaaattgtaataaatgtgtaagaaaggcattcccaaccaagacacaaaacccagtagccatgaaaaaaaagatagatttgactacatttttaaaaagtaaaacctttcactttttacaaaactttgataaaattagatttcataaataaaggagtgggaaaatacatgtaatagaacagaagatttaagataatataaagagcacctacaaacaacaaaaattggacaaaggctataaaaatattttataaataagaaatacagactataaacataaactttcaacctcgtaagcaatcaggaaaattaaagttaaaatgagatactatttttcaatacattgaaatggcagattattaaagattggtgatagtgctggagataatgtgaggaaaggagtattctcagtcattgtagaaattgatacagcttttggatggacagtttgacagtgtgtatcaacatgtgaaatgtctccagcctttgatctaatgactaattttaggcatccagcctgaagaaatattcacacaagtgcccaaagagtcagatacaagactgtgtgaagtgttttttgagataataaaaaactagaaacagcataaatgtacagaaatgcagaaattgttgaattagtacataccaatttctgacatataacactctgcagcagataaagacaatagctctctagtgtggacatgaaaatatttctaagacattgacaggacgaagaagttgcacagtaaccacgcactcctgtttacatttgtatagttaaaacttgtttacctatacgtagcatatatgcgtgtgtgcaccctagaaaagagtctgtgataacacatatcaagctattgacagcggttttgtctgctgaaggaggaaaaaaggggggcttctcacattttactccatttaattctaggttgtttggtttaaaaaaaaagtttttatgtacaacagacaatttttaaaattccttttcatcatagaaaatgaaaatgtgtactctgttatcctttacgctctgtccatttttttcttcaaaaatgtgtctgacctattatcaatgtgaatgaaaatgagctttgctacataacctcttttcagagctttgtattcctgaagtgttggagtcgcctacatggcatagtcaaatgtttttaacttaaccacaacccacagtaaaaatgaagctttctgcaaagttaaaagtagtagtcctggccccaccttccttgtgtgcacgtataattaatggaaaattgcatc

SEQ ID NO: 72686 - DNA, 1960 bp, Homo sapiens
ttgggtggtgttctagaggatcccagatgattgtccccccctccccaatgctgaccctaggattttccttccctgccctcacctgcaaatgagttaaagaagaggcgtgggaatccaggcagtggtttttcctttcggagcctcggttttctcatctgcagaatgggagcggtgggggtgggaaggtaaggatggtcgtggaagaaggcaggatggaactcggcctcatccccgaggccccagttcctatatcgggccccccattcatccactcacactcccagccaccatgttacactggactctaagccacttcttactccagtagtaaatttattcaataaacaatcattgacccatgcctactccatgccaggcccagtgctggacacagagacatgaagctctgtctgtgggagacagggattctgacacagacaccggacaaaccattgtcttggggagcccagaagagaaagtgggcagggtggggtcattggggaagatgctctagaggaattaatgctggaatggggtgttgaaggatgagtaggagttagttaggcattgagtttgccctgggcaaaagcccagaagtgggagtatgtggtatatcttcagagaactgggtaatttcagtgtggctgctgtgttgggcatggatggagaatcagcaagagaaatgctgtattaggactaataatccatctacgctgcttaagcaaaaaggtatttgttggtttatgttacttaatagtccaggggcacctggcttcaggtaggtttgatccaggcatcaggccattgcatctattttttcagtgtaagttgaattctagtaatttttatcaagtaagggctcctttcctggtggcacagatgacttcagcagttagaagtttctatccctccagctttctgcagcagaaagaccctcattgtcagtttcccagcaaaagtcccagggcagactctcattggcccaaatgggccatgtgattttctctaaaccaatcactgtgactctagagtggccagactcagagctgcacttagtaggggttcctcaaaggaaggtcaagtgtcatgagcaggagaaaaggcatgggagctggacagattatagtggttgaagtctgtgcagtacagaagggcggagcttattcacacagcacctttggggccaaaatgaataagctggactttctccccatggcactggggaaccatggaagttcagggaacttcagggaagaggcttggtcaattcctgagagcatcctctgtgctggggacacagtggtaatcaagacagccccaacactgccctcatagagctcacagtccaatggaggaggcagatgtgtcctcaggcagcgactgggcagggctggtataggggagtccagaggtgatgcctgcctcagccagggagggcttcctggaggagaaggagccagctagacatggataggagtgcgttttaggcacagcaaatggcacatacaagggccagggagcaagagagaggacaggtcctcaacaaatggcatgtgactttgtaagtgtagaattgctgtgaggtatggggctaggggcgtcagtagggccttgaaggttatggacaggggcctgggctttcttccaagggcactgggggagccatggcaaggttgtaggtagggtagagatgggcgggtttgtgctatgtgcagggtggaagggagggaagttgacaggtcagaagatcaggaaagaggtcggggctggacagatggggagagcgcagatagatttaagagagtcctgtgaggcaaagtgggcaggacctggtaacaggtgtctggactgtggctttggctggctcagaaggtccccactggcgtgtgtggtctatgtagcctctgggtgtggagctgggatcttcaactggggacagtacagtaaagaacatcacagc

SEQ ID NO: 72687 - DNA, 5129 bp, Homo sapiens
cgcctccctccgccgccgcttgggccggctccgcgccccctccgcggcccccgcccgcccgcctgcccgccgcccccatggcgcccggggtccccgctgcacggggccactaggaccctcggcgtcccttcccctcccccgccctgccccctctcccgccgcgcggacccgggcgttctcggcgcccagcttttgagctcgcgtccccaggccggcggggggggaggggaagagaggggaccctgggacccccgccccccccacccggccgcccctgccccccgggacccggagaagatgtcttcgcggacggtgctggccccgggcaacgatcggaactcggacacgcatggcaccttgggcagtggccgctcctcggacaaaggcccgtcctggtccagccgctcactgggtgcccgttgccggaactccatcgcctcctgtcccgaggagcagccccacgtgggcaactaccgcctgctgaggaccattgggaagggcaactttgccaaagtcaagctggctcggcacatcctcactggtcgggaggttgccatcaagattatcgacaaaacccagctgaatcccagcagcctgcagaagctgttccgagaagtccgcatcatgaagggcctaaaccaccccaacatcgtgaagctctttgaggtgattgagactgagaagacgctgtacctggtgatggagtacgcaagtgctggagaagtgtttgactacctcgtgtcgcatggccgcatgaaggagaaggaagctcgagccaagttccgacagattgtttcggctgtgcactattgtcaccagaaaaatattgtacacagggacctgaaggctgagaacctcttgctggatgccgaggccaacatcaagattgctgactttggcttcagcaacgagttcacgctgggatcgaagctggacacgttctgcgggagccccccatatgccgccccggagctgtttcagggcaagaagtacgacgggccggaggtggacatctggagcctgggagtcatcctgtacaccctcgtcagcggctccctgcccttcgacgggcacaacctcaaggagctgcgggagcgagtactcagagggaagtaccgggtccctttctacatgtcaacagactgtgagagcatcctgcggagatttttggtgctgaacccagctaaacgctgtactctcgagcaaatcatgaaagacaaatggatcaacatcggctatgagggtgaggagttgaagccatacacagagcccgaggaggacttcggggacaccaagagaattgaggtgatggtgggtatgggctacacacgggaagaaatcaaagagtccttgaccagccagaagtacaacgaagtgaccgccacctacctcctgctgggcaggaagactgaggagggtggggaccggggcgccccagggctggccctggcacgggtgcgggcgcccagcgacaccaccaacggaacaagttccagcaaaggcaccagccacagcaaagggcagcggagttcctcttccacctaccaccgccagcgcaggcatagcgatttctgtggcccatcccctgcacccctgcaccccaaacgcagcccgacgagcacgggggaggcggagctgaaggaggagcggctgccaggccggaaggcgagctgcagcaccgcggggagtgggagtcgagggctgcccccctccagccccatggtcagcagcgcccacaaccccaacaaggcagagatcccagagcggcggaaggacagcacgagcacccccaacaacctccctcctagcatgatgacccgcagaaacacctacgtttgcacagaacgcccgggggctgagcgcccgtcactgttgccaaatgggaaagaaaacagctcaggcaccccacgggtgccccctgcctccccctccagtcacagcctggcacccccatcaggggagcggagccgcctggcacgcggttccaccatccgcagcaccttccatggtggccaggtccgggaccggcgggcagggggtgggggtggtgggggtgtgcggaatgggccccctgcctctcccacactggcccatgaggctgcacccctgcccgccgggcggccccgccccaccaccaacctcttcaccaagctgacctccaaactgacccgaagggtcgcagacgaacctgagagaatcgggggacctgaggtcacaagttgccatctaccttgggatcaaacggaaaccgccccccggctgctccgattcccctggagtgtgaagctgaccagctcgcgccctcctgaggccctgatggcagctctgcgccaggccacagcagccgcccgctgccgctgccgccagccacagccgttcctgctggcctgcctgcacgggggtgcgggcgggcccgagcccctgtcccacttcgaagtggaggtctgccagctgccccggccaggcttgcggggagttctcttccgccgtgtggcgggcaccgccctggccttccgcaccctcgtcacccgcatctccaacgacctcgagctctgagccaccacggtcccagggcccttactcttcctctcccttgtcgccttcacttctacaggaggggaaggggccagggaggggattctccctttatcatcacctcagtttccctgaattatatttgggggcaaagattgtcccctctgctgttctctggggccgctcagcacagaagaaggatgagggggctcagcggggggagctggcaccttcctggagcctccagccagtcctgtcctccctcgccctaccaagagggcacctgaggagactttggggacagggcaggggcagggagggaaactgaggaaatcttccattcctcccaacagctcaaaattaggccttgggcaggggcagggagagctgctgagcctaaagactggagaatctgggggactgggagtgggggtcagagaggcagattccttcccctcccgtcccctcacgctcaaacccccacttcctgccccaggctggcgcggggcactttgtacaaatccttgtaaataccccacaccctcccctctgcaaaggtctcttgaggagctgccgctgtcacctacggtttttaagttattacaccccgaccctcctcctgtcagccccctcacctgcagcctgttgcccaataaatttaggagagtccccccctccccaatgctgaccctaggattttccttccctgccctcacctgcaaatgagttaaagaagaggcgtgggaatccaggcagtggtttttcctttcggagcctcggttttctcatctgcagaatgggagcggtgggggtgggaaggtaaggatggtcgtggaagaaggcaggatggaactcggcctcatccccgaggccccagttcctatatcgggccccccattcatccactcacactcccagccaccatgttacactggactctaagccacttcttactccagtagtaaatttattcaataaacaatcattgacccatgcctactccatgccaggcccagtgctggacacagagacatgaagctctgtctgtgggagacagggattctgacacagacaccggacaaaccattgtcttggggagcccagaagagaaagtgggcagggtggggtcattggggaagatgctctagaggaattaatgctggaatggggtgttgaaggatgagtaggagttagttaggcattgagtttgccctgggcaaaagcccagaagtgggagtatgtggtatatcttcagagaactgggtaatttcagtgtggctgctgtgttgggcatggatggagaatcagcaagagaaatgctgtattaggactaataatccatctacgctgcttaagcaaaaaggtatttgttggtttatgttacttaatagtccaggggcacctggcttcaggtaggtttgatccaggcatcaggccattgcatctattttttcagtgtaagttgaattctagtaatttttatcaagtaagggctcctttcctggtggcacagatgacttcagcagttagaagtttctatccctccagctttctgcagcagaaagaccctcattgtcagtttcccagcaaaagtcccagggcagactctcattggcccaaatgggccatgtgattttctctaaaccaatcactgtgactctagagtggccagactcagagctgcacttagtaggggttcctcaaaggaaggtcaagtgtcatgagcaggagaaaaggcatgggagctggacagattatagtggttgaagtctgtgcagtacagaagggcggagcttattcacacagcacctttggggccaaaatgaataagctggactttctccccatggcactggggaaccatggaagttcagggaacttcagggaagaggcttggtcaattcctgagagcatcctctgtgctggggacacagtggtaatcaagacagccccaacactgccctcatagagctcacagtccaatggaggaggcagatgtgtcctcaggcagcgactgggcagggctggtataggggagtccagaggtgatgcctgcctcagccagggagggcttcctggaggagaaggagccagctagacatggataggagtgcgttttaggcacagcaaatggcacatacaagggccagggagcaagagagaggacaggtcctcaacaaatggcatgtgactttgtaagtgtagaattgctgtgaggtatggggctaggggcgtcagtagggccttgaaggttatggacaggggcctgggctttcttccaagggcactgggggagccatggcaaggttgtaggtagggtagagatgggcgggtttgtgctatgtgcagggtggaagggagggaagttgacaggtcagaagatcaggaaagaggtcggggctggacagatggggagagcgcagatagatttaagagagtcctgtgaggcaaagtgggcaggacctggtaacaggtgtctggactgtggctttggctggctcagaaggtccccactggcgtgtgtggtctatgtagcctctgggtgtggagctgggatcttcaactggggacagtacagtaaagaacatcacagc

SEQ ID NO: 72688 - DNA, 4477 bp, Homo sapiens
gtggactatcgatataacaggtccgtctgcataacgtgaaggtgaacggacagactctcggagaattccagctgcaaatcccagctccaccactcactcgctgtgtgaactttaggtgggttaccagacctctctgtgcctcagtttccttgtatgtaaactgagggtgatctcgacacctgcctcaaagcgtggttgtgggtttaagcgtaaagtgctcacagcggcccctagagcacagtcagtgatcagtaaacatttcatggccgggcgcggtagctcacgcctgtaatctcagcactttgggaggcccaggtgggtggattgcctgtgcccaggagtttcaaaccagcctggacaacatagcaaaaccctgtctctactgaaaatacaaaaactgaggtgggaggatcagcagagcctggggaggccgaggctgcagtgagctgtgaccgtgccactgcactccagcctgggtgacagagtgacaccctgtctcaaaaaaaaagagaaatggatggaagttaaagtttctgggagtctgaaacttctctccatccccccctcccagaggtgatggtgggtatgggctacacacgggaagaaatcaaagagtccttgaccagccagaagtacaacgaagtgaccgccacctacctcctgctgggcaggaagactgaggagggtggggaccggggcgccccagggctggccctggcacgggtgcgggcgcccagcgacaccaccaacggaacaagttccagcaaaggcaccagccacagcaaagggcagcggagttcctcttccacctaccaccgccagcgcaggcatagcgatttctgtggcccatcccctgcacccctgcaccccaaacgcagcccgacgagcacgggggaggcggagctgaaggaggagcggctgccaggccggaaggcgagctgcagcaccgcggggagtgggagtcgagggctgcccccctccagccccatggtcagcagcgcccacaaccccaacaaggcagagatcccagagcggcggaaggacagcacgagcacccccaacaacctccctcctagcatgatgacccgcagaaacacctacgtttgcacagaacgcccgggggctgagcgcccgtcactgttgccaaatgggaaagaaaacagctcaggcaccccacgggtgccccctgcctccccctccagtcacagcctggcacccccatcaggggagcggagccgcctggcacgcggttccaccatccgcagcaccttccatggtggccaggtccgggaccggcgggcagggggtgggggtggtgggggtgtgcggaatgggccccctgcctctcccacactggcccatgaggctgcacccctgcccgccgggcggccccgccccaccaccaacctcttcaccaagctgacctccaaactgacccgaagggttaccctcgatccctctaaacggcagaactctaaccgctgtgtttcgggcgcctctctgccccagggatccaagatcaggtcgcagacgaacctgagagaatcgggggacctgaggtcacaagttgccatctaccttgggatcaaacggaaaccgccccccggctgctccgattcccctggagtgtgaagctgaccagctcgcgccctcctgaggccctgatggcagctctgcgccaggccacagcagccgcccgctgccgctgccgccagccacagccgttcctgctggcctgcctgcacgggggtgcgggcgggcccgagcccctgtcccacttcgaagtggaggtctgccagctgccccggccaggcttgcggggagttctcttccgccgtgtggcgggcaccgccctggccttccgcaccctcgtcacccgcatctccaacgacctcgagctctgagccaccacggtcccagggcccttactcttcctctcccttgtcgccttcacttctacaggaggggaaggggccagggaggggattctccctttatcatcacctcagtttccctgaattatatttgggggcaaagattgtcccctctgctgttctctggggccgctcagcacagaagaaggatgagggggctcagcggggggagctggcaccttcctggagcctccagccagtcctgtcctccctcgccctaccaagagggcacctgaggagactttggggacagggcaggggcagggagggaaactgaggaaatcttccattcctcccaacagctcaaaattaggccttgggcaggggcagggagagctgctgagcctaaagactggagaatctgggggactgggagtgggggtcagagaggcagattccttcccctcccgtcccctcacgctcaaacccccacttcctgccccaggctggcgcggggcactttgtacaaatccttgtaaataccccacaccctcccctctgcaaaggtctcttgaggagctgccgctgtcacctacggtttttaagttattacaccccgaccctcctcctgtcagccccctcacctgcagcctgttgcccaataaatttaggagagtccccccctccccaatgctgaccctaggattttccttccctgccctcacctgcaaatgagttaaagaagaggcgtgggaatccaggcagtggtttttcctttcggagcctcggttttctcatctgcagaatgggagcggtgggggtgggaaggtaaggatggtcgtggaagaaggcaggatggaactcggcctcatccccgaggccccagttcctatatcgggccccccattcatccactcacactcccagccaccatgttacactggactctaagccacttcttactccagtagtaaatttattcaataaacaatcattgacccatgcctactccatgccaggcccagtgctggacacagagacatgaagctctgtctgtgggagacagggattctgacacagacaccggacaaaccattgtcttggggagcccagaagagaaagtgggcagggtggggtcattggggaagatgctctagaggaattaatgctggaatggggtgttgaaggatgagtaggagttagttaggcattgagtttgccctgggcaaaagcccagaagtgggagtatgtggtatatcttcagagaactgggtaatttcagtgtggctgctgtgttgggcatggatggagaatcagcaagagaaatgctgtattaggactaataatccatctacgctgcttaagcaaaaaggtatttgttggtttatgttacttaatagtccaggggcacctggcttcaggtaggtttgatccaggcatcaggccattgcatctattttttcagtgtaagttgaattctagtaatttttatcaagtaagggctcctttcctggtggcacagatgacttcagcagttagaagtttctatccctccagctttctgcagcagaaagaccctcattgtcagtttcccagcaaaagtcccagggcagactctcattggcccaaatgggccatgtgattttctctaaaccaatcactgtgactctagagtggccagactcagagctgcacttagtaggggttcctcaaaggaaggtcaagtgtcatgagcaggagaaaaggcatgggagctggacagattatagtggttgaagtctgtgcagtacagaagggcggagcttattcacacagcacctttggggccaaaatgaataagctggactttctccccatggcactggggaaccatggaagttcagggaacttcagggaagaggcttggtcaattcctgagagcatcctctgtgctggggacacagtggtaatcaagacagccccaacactgccctcatagagctcacagtccaatggaggaggcagatgtgtcctcaggcagcgactgggcagggctggtataggggagtccagaggtgatgcctgcctcagccagggagggcttcctggaggagaaggagccagctagacatggataggagtgcgttttaggcacagcaaatggcacatacaagggccagggagcaagagagaggacaggtcctcaacaaatggcatgtgactttgtaagtgtagaattgctgtgaggtatggggctaggggcgtcagtagggccttgaaggttatggacaggggcctgggctttcttccaagggcactgggggagccatggcaaggttgtaggtagggtagagatgggcgggtttgtgctatgtgcagggtggaagggagggaagttgacaggtcagaagatcaggaaagaggtcggggctggacagatggggagagcgcagatagatttaagagagtcctgtgaggcaaagtgggcaggacctggtaacaggtgtctggactgtggctttggctggctcagaaggtccccactggcgtgtgtggtctatgtagcctctgggtgtggagctgggatcttcaactggggacagtacagtaaagaacatcacagc

SEQ ID NO: 72689 - DNA, 2997 bp, Homo sapiens
  misc_feature (1)..(1): n is a, c, g, or t
  misc_feature (4)..(5): n is a, c, g, or t
  misc_feature (8)..(8): n is a, c, g, or t
ngtnngcntttccagcagcgctgacctccaaactgacccgaaggtcgcagacgaacctgagagaatcgggggacctgaggtcacaagttgccatctaccttgggatcaaacggaaaccgccccccggctgctccgattcccctggagtgtgaagctgaccagctcgcgccctcctgaggccctgatggcagctctgcgccaggccacagcagccgcccgctgccgctgccgccagccacagccgttcctgctggcctgcctgcacgggggtgcgggcgggcccgagcccctgtcccacttcgaagtggaggtctgccagctgccccggccaggcttgcggggagttctcttccgccgtgtggcgggcaccgccctggccttccgcaccctcgtcacccgcatctccaacgacctcgagctctgagccaccacggtcccagggcccttactcttcctctcccttgtcgccttcacttctacaggaggggaaggggccagggaggggattctccctttatcatcacctcagtttccctgaattatatttgggggcaaagattgtcccctctgctgttctctggggccgctcagcacagaagaaggatgagggggctcagcggggggagctggcaccttcctggagcctccagccagtcctgtcctccctcgccctaccaagagggcacctgaggagactttggggacagggcaggggcagggagggaaactgaggaaatcttccattcctcccaacagctcaaaattaggccttgggcaggggcagggagagctgctgagcctaaagactggagaatctgggggactgggagtgggggtcagagaggcagattccttcccctcccgtcccctcacgctcaaacccccacttcctgccccaggctggcgcggggcactttgtacaaatccttgtaaataccccacaccctcccctctgcaaaggtctcttgaggagctgccgctgtcacctacggtttttaagttattacaccccgaccctcctcctgtcagccccctcacctgcagcctgttgcccaataaatttaggagagtccccccctccccaatgctgaccctaggattttccttccctgccctcacctgcaaatgagttaaagaagaggcgtgggaatccaggcagtggtttttcctttcggagcctcggttttctcatctgcagaatgggagcggtgggggtgggaaggtaaggatggtcgtggaagaaggcaggatggaactcggcctcatccccgaggccccagttcctatatcgggccccccattcatccactcacactcccagccaccatgttacactggactctaagccacttcttactccagtagtaaatttattcaataaacaatcattgacccatgcctactccatgccaggcccagtgctggacacagagacatgaagctctgtctgtgggagacagggattctgacacagacaccggacaaaccattgtcttggggagcccagaagagaaagtgggcagggtggggtcattggggaagatgctctagaggaattaatgctggaatggggtgttgaaggatgagtaggagttagttaggcattgagtttgccctgggcaaaagcccagaagtgggagtatgtggtatatcttcagagaactgggtaatttcagtgtggctgctgtgttgggcatggatggagaatcagcaagagaaatgctgtattaggactaataatccatctacgctgcttaagcaaaaaggtatttgttggtttatgttacttaatagtccaggggcacctggcttcaggtaggtttgatccaggcatcaggccattgcatctattttttcagtgtaagttgaattctagtaatttttatcaagtaagggctcctttcctggtggcacagatgacttcagcagttagaagtttctatccctccagctttctgcagcagaaagaccctcattgtcagtttcccagcaaaagtcccagggcagactctcattggcccaaatgggccatgtgattttctctaaaccaatcactgtgactctagagtggccagactcagagctgcacttagtaggggttcctcaaaggaaggtcaagtgtcatgagcaggagaaaaggcatgggagctggacagattatagtggttgaagtctgtgcagtacagaagggcggagcttattcacacagcacctttggggccaaaatgaataagctggactttctccccatggcactggggaaccatggaagttcagggaacttcagggaagaggcttggtcaattcctgagagcatcctctgtgctggggacacagtggtaatcaagacagccccaacactgccctcatagagctcacagtccaatggaggaggcagatgtgtcctcaggcagcgactgggcagggctggtataggggagtccagaggtgatgcctgcctcagccagggagggcttcctggaggagaaggagccagctagacatggataggagtgcgttttaggcacagcaaatggcacatacaagggccagggagcaagagagaggacaggtcctcaacaaatggcatgtgactttgtaagtgtagaattgctgtgaggtatggggctaggggcgtcagtagggccttgaaggttatggacaggggcctgggctttcttccaagggcactgggggagccatggcaaggttgtaggtagggtagagatgggcgggtttgtgctatgtgcagggtggaagggagggaagttgacaggtcagaagatcaggaaagaggtcggggctggacagatggggagagcgcagatagatttaagagagtcctgtgaggcaaagtgggcaggacctggtaacaggtgtctggactgtggctttggctggctcagaaggtccccactggcgtgtgtggtctatgtagcctctgggtgtggagctgggatcttcaactggggacagtacagtaaagaacatcacagc

SEQ ID NO: 72690 - DNA, 199 bp, Homo sapiens
gtaatcttgaggtaattttgacagatattgtcagaatggcccacacagagattgcaacccacgtgaggaattctcaggttccaacgatcccccagagtcagttctgggtttccgtggtgatgccagctctaaacggtaccccctcccccaggtggcccatcccctgcacccctgcaccccaaacgcagcccgacgagca

SEQ ID NO: 72691 - DNA, 5209 bp, Homo sapiens
cgcctccctccgccgccgcttgggccggctccgcgccccctccgcggcccccgcccgcccgcctgcccgccgcccccatggcgcccggggtccccgctgcacggggccactaggaccctcggcgtcccttcccctcccccgccctgccccctctcccgccgcgcggacccgggcgttctcggcgcccagcttttgagctcgcgtccccaggccggcggggggggaggggaagagaggggaccctgggacccccgccccccccacccggccgcccctgccccccgggacccggagaagatgtcttcgcggacggtgctggccccgggcaacgatcggaactcggacacgcatggcaccttgggcagtggccgctcctcggacaaaggcccgtcctggtccagccgctcactgggtgcccgttgccggaactccatcgcctcctgtcccgaggagcagccccacgtgggcaactaccgcctgctgaggaccattgggaagggcaactttgccaaagtcaagctggctcggcacatcctcactggtcgggaggttgccatcaagattatcgacaaaacccagctgaatcccagcagcctgcagaagctgttccgagaagtccgcatcatgaagggcctaaaccaccccaacatcgtgaagctctttgaggtgattgagactgagaagacgctgtacctggtgatggagtacgcaagtgctggagaagtgtttgactacctcgtgtcgcatggccgcatgaaggagaaggaagctcgagccaagttccgacagattgtttcggctgtgcactattgtcaccagaaaaatattgtacacagggacctgaaggctgagaacctcttgctggatgccgaggccaacatcaagattgctgactttggcttcagcaacgagttcacgctgggatcgaagctggacacgttctgcgggagccccccatatgccgccccggagctgtttcagggcaagaagtacgacgggccggaggtggacatctggagcctgggagtcatcctgtacaccctcgtcagcggctccctgcccttcgacgggcacaacctcaaggagctgcgggagcgagtactcagagggaagtaccgggtccctttctacatgtcaacagactgtgagagcatcctgcggagatttttggtgctgaacccagctaaacgctgtactctcgagcaaatcatgaaagacaaatggatcaacatcggctatgagggtgaggagttgaagccatacacagagcccgaggaggacttcggggacaccaagagaattgaggtgatggtgggtatgggctacacacgggaagaaatcaaagagtccttgaccagccagaagtacaacgaagtgaccgccacctacctcctgctgggcaggaagactgaggagggtggggaccggggcgccccagggctggccctggcacgggtgcgggcgcccagcgacaccaccaacggaacaagttccagcaaaggcaccagccacagcaaagggcagcggagttcctcttccacctaccaccgccagcgcaggcatagcgatttctgtggcccatcccctgcacccctgcaccccaaacgcagcccgacgagcacgggggaggcggagctgaaggaggagcggctgccaggccggaaggcgagctgcagcaccgcggggagtgggagtcgagggctgcccccctccagccccatggtcagcagcgcccacaaccccaacaaggcagagatcccagagcggcggaaggacagcacgagcacccccaacaacctccctcctagcatgatgacccgcagaaacacctacgtttgcacagaacgcccgggggctgagcgcccgtcactgttgccaaatgggaaagaaaacagctcaggcaccccacgggtgccccctgcctccccctccagtcacagcctggcacccccatcaggggagcggagccgcctggcacgcggttccaccatccgcagcaccttccatggtggccaggtccgggaccggcgggcagggggtgggggtggtgggggtgtgcggaatgggccccctgcctctcccacactggcccatgaggctgcacccctgcccgccgggcggccccgccccaccaccaacctcttcaccaagctgacctccaaactgacccgaagggttaccctcgatccctctaaacggcagaactctaaccgctgtgtttcgggcgcctctctgccccagggatccaagatcaggtcgcagacgaacctgagagaatcgggggacctgaggtcacaagttgccatctaccttgggatcaaacggaaaccgccccccggctgctccgattcccctggagtgtgaagctgaccagctcgcgccctcctgaggccctgatggcagctctgcgccaggccacagcagccgcccgctgccgctgccgccagccacagccgttcctgctggcctgcctgcacgggggtgcgggcgggcccgagcccctgtcccacttcgaagtggaggtctgccagctgccccggccaggcttgcggggagttctcttccgccgtgtggcgggcaccgccctggccttccgcaccctcgtcacccgcatctccaacgacctcgagctctgagccaccacggtcccagggcccttactcttcctctcccttgtcgccttcacttctacaggaggggaaggggccagggaggggattctccctttatcatcacctcagtttccctgaattatatttgggggcaaagattgtcccctctgctgttctctggggccgctcagcacagaagaaggatgagggggctcagcggggggagctggcaccttcctggagcctccagccagtcctgtcctccctcgccctaccaagagggcacctgaggagactttggggacagggcaggggcagggagggaaactgaggaaatcttccattcctcccaacagctcaaaattaggccttgggcaggggcagggagagctgctgagcctaaagactggagaatctgggggactgggagtgggggtcagagaggcagattccttcccctcccgtcccctcacgctcaaacccccacttcctgccccaggctggcgcggggcactttgtacaaatccttgtaaataccccacaccctcccctctgcaaaggtctcttgaggagctgccgctgtcacctacggtttttaagttattacaccccgaccctcctcctgtcagccccctcacctgcagcctgttgcccaataaatttaggagagtccccccctccccaatgctgaccctaggattttccttccctgccctcacctgcaaatgagttaaagaagaggcgtgggaatccaggcagtggtttttcctttcggagcctcggttttctcatctgcagaatgggagcggtgggggtgggaaggtaaggatggtcgtggaagaaggcaggatggaactcggcctcatccccgaggccccagttcctatatcgggccccccattcatccactcacactcccagccaccatgttacactggactctaagccacttcttactccagtagtaaatttattcaataaacaatcattgacccatgcctactccatgccaggcccagtgctggacacagagacatgaagctctgtctgtgggagacagggattctgacacagacaccggacaaaccattgtcttggggagcccagaagagaaagtgggcagggtggggtcattggggaagatgctctagaggaattaatgctggaatggggtgttgaaggatgagtaggagttagttaggcattgagtttgccctgggcaaaagcccagaagtgggagtatgtggtatatcttcagagaactgggtaatttcagtgtggctgctgtgttgggcatggatggagaatcagcaagagaaatgctgtattaggactaataatccatctacgctgcttaagcaaaaaggtatttgttggtttatgttacttaatagtccaggggcacctggcttcaggtaggtttgatccaggcatcaggccattgcatctattttttcagtgtaagttgaattctagtaatttttatcaagtaagggctcctttcctggtggcacagatgacttcagcagttagaagtttctatccctccagctttctgcagcagaaagaccctcattgtcagtttcccagcaaaagtcccagggcagactctcattggcccaaatgggccatgtgattttctctaaaccaatcactgtgactctagagtggccagactcagagctgcacttagtaggggttcctcaaaggaaggtcaagtgtcatgagcaggagaaaaggcatgggagctggacagattatagtggttgaagtctgtgcagtacagaagggcggagcttattcacacagcacctttggggccaaaatgaataagctggactttctccccatggcactggggaaccatggaagttcagggaacttcagggaagaggcttggtcaattcctgagagcatcctctgtgctggggacacagtggtaatcaagacagccccaacactgccctcatagagctcacagtccaatggaggaggcagatgtgtcctcaggcagcgactgggcagggctggtataggggagtccagaggtgatgcctgcctcagccagggagggcttcctggaggagaaggagccagctagacatggataggagtgcgttttaggcacagcaaatggcacatacaagggccagggagcaagagagaggacaggtcctcaacaaatggcatgtgactttgtaagtgtagaattgctgtgaggtatggggctaggggcgtcagtagggccttgaaggttatggacaggggcctgggctttcttccaagggcactgggggagccatggcaaggttgtaggtagggtagagatgggcgggtttgtgctatgtgcagggtggaagggagggaagttgacaggtcagaagatcaggaaagaggtcggggctggacagatggggagagcgcagatagatttaagagagtcctgtgaggcaaagtgggcaggacctggtaacaggtgtctggactgtggctttggctggctcagaaggtccccactggcgtgtgtggtctatgtagcctctgggtgtggagctgggatcttcaactggggacagtacagtaaagaacatcacagc

SEQ ID NO: 72692 - DNA, 4858 bp, Homo sapiens
cgcctccctccgccgccgcttgggccggctccgcgccccctccgcggcccccgcccgcccgcctgcccgccgcccccatggcgcccggggtccccgctgcacggggccactaggaccctcggcgtcccttcccctcccccgccctgccccctctcccgccgcgcggacccgggcgttctcggcgcccagcttttgagctcgcgtccccaggccggcggggggggaggggaagagaggggaccctgggacccccgccccccccacccggccgcccctgccccccgggacccggagaagatgtcttcgcggacggtgctggccccgggcaacgatcggaactcggacacgcatggcaccttgggcagtggccgctcctcggacaaaggcccgtcctggtccagccgctcactgggtgcccgttgccggaactccatcgcctcctgtcccgaggagcagccccacgtgggcaactaccgcctgctgaggaccattgggaagggcaactttgccaaagtcaagctggctcggcacatcctcactggtcgggaggttgccatcaagattatcgacaaaacccagctgaatcccagcagcctgcagaagctgttccgagaagtccgcatcatgaagggcctaaaccaccccaacatcgtgaagctctttgaggtgattgagactgagaagacgctgtacctggtgatggagtacgcaagtgctggagaagtgtttgactacctcgtgtcgcatggccgcatgaaggagaaggaagctcgagccaagttccgacagattgtttcggctgtgcactattgtcaccagaaaaatattgtacacagggacctgaaggctgagaacctcttgctggatgccgaggccaacatcaagattgctgactttggcttcagcaacgagttcacgctgggatcgaagctggacacgttctgcgggagccccccatatgccgccccggagctgtttcagggcaagaagtacgacgggccggaggtggacatctggagcctgggagtcatcctgtacaccctcgtcagcggctccctgcccttcgacgggcacaacctcaaggagctgcgggagcgagtactcagagggaagtaccgggtccctttctacatgtcaacagactgtgagagcatcctgcggagatttttggtgctgaacccagctaaacgctgtactctcgagcaaatcatgaaagacaaatggatcaacatcggctatgagggtgaggagttgaagccatacacagagcccgaggaggacttcggggacaccaagagaattgaggtgatggtgggtatgggctacacacgggaagaaatcaaagagtccttgaccagccagaagtacaacgaagtgaccgccacctacctcctgctgggcaggaagactgaggagggtggggaccggggcgccccagggctggccctggcacgggtgcgggcgcccagcgacaccaccaacggaacaagttccagcaaaggcaccagccacagcaaagggcagcggagttcctcttccacctaccaccgccagcgcaggcatagcgatttctgtggcccatcccctgcacccctgcaccccaaacgcagcccgacgagcacgggggaggcggagctgaaggaggagcggctgccaggccggaaggcgagctgcagcaccgcggggagtgggagtcgagggctgcccccctccagccccatggtcagcagcgcccacaaccccaacaaggcagagatcccagagcggcggaaggacagcacgagcacccccaacaacctccctcctagcatgatgacccgcagggttaccctcgatccctctaaacggcagaactctaaccgctgtgtttcgggcgcctctctgccccagggatccaagatcaggtcgcagacgaacctgagagaatcgggggacctgaggtcacaagttgccatctaccttgggatcaaacggaaaccgccccccggctgctccgattcccctggagtgtgaagctgaccagctcgcgccctcctgaggccctgatggcagctctgcgccaggccacagcagccgcccgctgccgctgccgccagccacagccgttcctgctggcctgcctgcacgggggtgcgggcgggcccgagcccctgtcccacttcgaagtggaggtctgccagctgccccggccaggcttgcggggagttctcttccgccgtgtggcgggcaccgccctggccttccgcaccctcgtcacccgcatctccaacgacctcgagctctgagccaccacggtcccagggcccttactcttcctctcccttgtcgccttcacttctacaggaggggaaggggccagggaggggattctccctttatcatcacctcagtttccctgaattatatttgggggcaaagattgtcccctctgctgttctctggggccgctcagcacagaagaaggatgagggggctcagcggggggagctggcaccttcctggagcctccagccagtcctgtcctccctcgccctaccaagagggcacctgaggagactttggggacagggcaggggcagggagggaaactgaggaaatcttccattcctcccaacagctcaaaattaggccttgggcaggggcagggagagctgctgagcctaaagactggagaatctgggggactgggagtgggggtcagagaggcagattccttcccctcccgtcccctcacgctcaaacccccacttcctgccccaggctggcgcggggcactttgtacaaatccttgtaaataccccacaccctcccctctgcaaaggtctcttgaggagctgccgctgtcacctacggtttttaagttattacaccccgaccctcctcctgtcagccccctcacctgcagcctgttgcccaataaatttaggagagtccccccctccccaatgctgaccctaggattttccttccctgccctcacctgcaaatgagttaaagaagaggcgtgggaatccaggcagtggtttttcctttcggagcctcggttttctcatctgcagaatgggagcggtgggggtgggaaggtaaggatggtcgtggaagaaggcaggatggaactcggcctcatccccgaggccccagttcctatatcgggccccccattcatccactcacactcccagccaccatgttacactggactctaagccacttcttactccagtagtaaatttattcaataaacaatcattgacccatgcctactccatgccaggcccagtgctggacacagagacatgaagctctgtctgtgggagacagggattctgacacagacaccggacaaaccattgtcttggggagcccagaagagaaagtgggcagggtggggtcattggggaagatgctctagaggaattaatgctggaatggggtgttgaaggatgagtaggagttagttaggcattgagtttgccctgggcaaaagcccagaagtgggagtatgtggtatatcttcagagaactgggtaatttcagtgtggctgctgtgttgggcatggatggagaatcagcaagagaaatgctgtattaggactaataatccatctacgctgcttaagcaaaaaggtatttgttggtttatgttacttaatagtccaggggcacctggcttcaggtaggtttgatccaggcatcaggccattgcatctattttttcagtgtaagttgaattctagtaatttttatcaagtaagggctcctttcctggtggcacagatgacttcagcagttagaagtttctatccctccagctttctgcagcagaaagaccctcattgtcagtttcccagcaaaagtcccagggcagactctcattggcccaaatgggccatgtgattttctctaaaccaatcactgtgactctagagtggccagactcagagctgcacttagtaggggttcctcaaaggaaggtcaagtgtcatgagcaggagaaaaggcatgggagctggacagattatagtggttgaagtctgtgcagtacagaagggcggagcttattcacacagcacctttggggccaaaatgaataagctggactttctccccatggcactggggaaccatggaagttcagggaacttcagggaagaggcttggtcaattcctgagagcatcctctgtgctggggacacagtggtaatcaagacagccccaacactgccctcatagagctcacagtccaatggaggaggcagatgtgtcctcaggcagcgactgggcagggctggtataggggagtccagaggtgatgcctgcctcagccagggagggcttcctggaggagaaggagccagctagacatggataggagtgcgttttaggcacagcaaatggcacatacaagggccagggagcaagagagaggacaggtcctcaacaaatggcatgtgactttgtaagtgtagaattgctgtgaggtatggggctaggggcgtcagtagggccttgaaggttatggacaggggcctgggctttcttccaagggcactgggggagccatggcaaggttgtaggtagggtagagatgggcgggtttgtgctatgtgcagggtggaagggagggaagttgacaggtcagaagatcaggaaagaggtcggggctggacagatggggagagcgcagatagatttaagagagtcctgtgaggcaaagtgggcaggacctggtaacaggtgtctggactgtggctttggctggctcagaaggtccccactggcgtgtgtggtctatgtagcctctgggtgtggagctgggatcttcaactggggacagtacagtaaagaacatcacagc

SEQ ID NO: 72693 - DNA, 3310 bp, Homo sapiens
cgcctccctccgccgccgcttgggccggctccgcgccccctccgcggcccccgcccgcccgcctgcccgccgcccccatggcgcccggggtccccgctgcacggggccactaggaccctcggcgtcccttcccctcccccgccctgccccctctcccgccgcgcggacccgggcgttctcggcgcccagcttttgagctcgcgtccccaggccggcggggggggaggggaagagaggggaccctgggacccccgccccccccacccggccgcccctgccccccgggacccggagaagatgtcttcgcggacggtgctggccccgggcaacgatcggaactcggacacgcatggcaccttgggcagtggccgctcctcggacaaaggcccgtcctggtccagccgctcactgggtgcccgttgccggaactccatcgcctcctgtcccgaggagcagccccacgtgggcaactaccgcctgctgaggaccattgggaagggcaactttgccaaagtcaagctggctcggcacatcctcactggtcgggaggttgccatcaagattatcgacaaaacccagctgaatcccagcagcctgcagaagctgttccgagaagtccgcatcatgaagggcctaaaccaccccaacatcgtgaagctctttgaggtgattgagactgagaagacgctgtacctggtgatggagtacgcaagtgctggagaagtgtttgactacctcgtgtcgcatggccgcatgaaggagaaggaagctcgagccaagttccgacagattgtttcggctgtgcactattgtcaccagaaaaatattgtacacagggacctgaaggctgagaacctcttgctggatgccgaggccaacatcaagattgctgactttggcttcagcaacgagttcacgctgggatcgaagctggacacgttctgcgggagccccccatatgccgccccggagctgtttcagggcaagaagtacgacgggccggaggtggacatctggagcctgggagtcatcctgtacaccctcgtcagcggctccctgcccttcgacgggcacaacctcaaggagctgcgggagcgagtactcagagggaagtaccgggtccctttctacatgtcaacagactgtgagagcatcctgcggagatttttggtgctgaacccagctaaacgctgtactctcgagcaaatcatgaaagacaaatggatcaacatcggctatgagggtgaggagttgaagccatacacagagcccgaggaggacttcggggacaccaagagaattgaggtgatggtgggtatgggctacacacgggaagaaatcaaagagtccttgaccacctgttgcccaataaatttaggagagtccccccctccccaatgctgaccctaggattttccttccctgccctcacctgcaaatgagttaaagaagaggcgtgggaatccaggcagtggtttttcctttcggagcctcggttttctcatctgcagaatgggagcggtgggggtgggaaggtaaggatggtcgtggaagaaggcaggatggaactcggcctcatccccgaggccccagttcctatatcgggccccccattcatccactcacactcccagccaccatgttacactggactctaagccacttcttactccagtagtaaatttattcaataaacaatcattgacccatgcctactccatgccaggcccagtgctggacacagagacatgaagctctgtctgtgggagacagggattctgacacagacaccggacaaaccattgtcttggggagcccagaagagaaagtgggcagggtggggtcattggggaagatgctctagaggaattaatgctggaatggggtgttgaaggatgagtaggagttagttaggcattgagtttgccctgggcaaaagcccagaagtgggagtatgtggtatatcttcagagaactgggtaatttcagtgtggctgctgtgttgggcatggatggagaatcagcaagagaaatgctgtattaggactaataatccatctacgctgcttaagcaaaaaggtatttgttggtttatgttacttaatagtccaggggcacctggcttcaggtaggtttgatccaggcatcaggccattgcatctattttttcagtgtaagttgaattctagtaatttttatcaagtaagggctcctttcctggtggcacagatgacttcagcagttagaagtttctatccctccagctttctgcagcagaaagaccctcattgtcagtttcccagcaaaagtcccagggcagactctcattggcccaaatgggccatgtgattttctctaaaccaatcactgtgactctagagtggccagactcagagctgcacttagtaggggttcctcaaaggaaggtcaagtgtcatgagcaggagaaaaggcatgggagctggacagattatagtggttgaagtctgtgcagtacagaagggcggagcttattcacacagcacctttggggccaaaatgaataagctggactttctccccatggcactggggaaccatggaagttcagggaacttcagggaagaggcttggtcaattcctgagagcatcctctgtgctggggacacagtggtaatcaagacagccccaacactgccctcatagagctcacagtccaatggaggaggcagatgtgtcctcaggcagcgactgggcagggctggtataggggagtccagaggtgatgcctgcctcagccagggagggcttcctggaggagaaggagccagctagacatggataggagtgcgttttaggcacagcaaatggcacatacaagggccagggagcaagagagaggacaggtcctcaacaaatggcatgtgactttgtaagtgtagaattgctgtgaggtatggggctaggggcgtcagtagggccttgaaggttatggacaggggcctgggctttcttccaagggcactgggggagccatggcaaggttgtaggtagggtagagatgggcgggtttgtgctatgtgcagggtggaagggagggaagttgacaggtcagaagatcaggaaagaggtcggggctggacagatggggagagcgcagatagatttaagagagtcctgtgaggcaaagtgggcaggacctggtaacaggtgtctggactgtggctttggctggctcagaaggtccccactggcgtgtgtggtctatgtagcctctgggtgtggagctgggatcttcaactggggacagtacagtaaagaacatcacagc

SEQ ID NO: 72694 - DNA, 313 bp, Homo sapiens
agaatttggctgtgttttaatatcacgtatttgcagtgaccttgtagaatccgtactgattctatatttttagggaaaaaacaacaataaagaacattgtccatttatttgagtatattaatggaaaattatgaaataatttgattaacctaagggttctaatatttgaaaagttggttttcaataatggttttaaatttcttggtaattttttacactatgtgagattgtttctattttcatttttgaaagtttgttatctcaatttatatgtgttgaaataggtttattttcacatatgtgtatattttaa

SEQ ID NO: 72695 - DNA, 719 bp, Homo sapiens
cagaatgatatggtttgactatgtccccatccatatctcatcttgaattcccatcggttatgggagggacccagtgggaggtaattgaatcatgggtgcaggtcttttccatgctgttctcgagttagggaataagtcttacgagatctgatggttacaaaaaggggagcttccctgcacaagcattcctctctttgcctgccaccatacataagatgtgacttgctcctccttgccctctgccatgattgtgaggcttccccagccatgtagaattgtaagtccagttaaacctctttcttttgtaaattgcccagtcttgggtatgtctttatcatcagcatgaaaacagattaatacagtgtgacctcctagctacactaactacaaatcctaagaatgctaaccagtaatactggtgctacaaactatgctaactaactaatgaacataatactaacaataccaactgtatactgactacactaacagtgataaccaacaatactaataatgctaaccagcaacattaactaaataaaaaatgaaaaaatgagaaaaacaacaaaggaagtggaagaaaaatgggaagaagatataagaatttaaaaagtgggacaaaagagtaaaggaggatgagaaaataaaaagaaaaaataataagaaaaaggaaataaaaaaatgacaaaaagaaaaatgaggacaaagacggcaagcgg

SEQ ID NO: 72696 - DNA, 571 bp, Homo sapiens
ggaggaatgaacgactccagacacaccgccttaagatctgtgacactcaccgcgaaggtctgcagcttcattcctgatccagcgagaccatgaacccaccagaaggaaaaaactccggacacatccgaacgtctagaagaaacaaactccagacacaccgcctgtaagaactgtaacggtcaccgcgagggtccgcggtttcattcttgaagtcagtgagaccaagaacccaccatttctggacacactaccatgccagagatccaggtaggtctctggatctttgagacccccacctcacacctccttattatgaaacattatggtttttacaattacaaaagtagtataggcttgtgaaaacctcctacaaaactctttatttggtatagagttccaagagtctcctcgtaatcctctccaattttaataaattttttttatgtatactgtgtataacttcatgtgagattttatatatgtatgtatgtgatcttttatgtctttactgagaagtttatgatggacttctttccatgttcatatatatataatacatattttatatcta

SEQ ID NO: 72697 - DNA, 1555 bp, Homo sapiens
ggaggaatgaacgactccagacacaccgccttaagatctgtgacactcaccgcgaaggtctgcagcttcattcctgatccagcgagaccatgaacccaccagaaggaaaaaactccggacacatccgaacgtctagaagaaacaaactccagacacaccgcctgtaagaactgtaacggtcaccgcgagggtccgcggtttcattcttgaagtcagtgagaccaagaacccaccatttctggacacactaccatgccagagatccaggggctgcagcatgctgaaagaaaacagaagcctgtggagtgagccaagatcaaccaggaaataaaccctttcccttgcgatgtctctccagcgccctctactgacaaacctgctttagtgccagtttgtagagaattgtctttgctgatctctttattatgatgaaaattctctggatggaagggtcatcagctgccgtctcctttgctactctgctacatatccttacaatttggtttagaattttagtaccactaacattttttggtgcatattttggaaataaagaaaagattagttgtccagttcagacaaaccagatcccctgtcagattcctccatagaacttctttacaaaaccacttcttggcatcataattggtggcattttccccttcggctgtatttttattcaactctttttcattctgaacagtatttggaaaagccttagttgcataagtggaattccttttcacatttgagaaacagaggagagacagttggatttttttcctgtttctggttaattgctaaaatctacagtgtgctgaaggtggagtaaagtatttccccaaaggattccaagcacatctcccttgcccttgaatatctgtatatctatatgaacatcaattgagatatatatgtgtgtgcccctaattacataattttaagcatatatataaaaatgtaaaatctcattgtctggcctcagtttgtatgacacaaaatactgattgtatggaagaaaacagattgggaaacagatttattctatatcatattttcctgaaaagctaccttaaaaagatttaaattaaagcaattagagcaagggaggcacatttctttaaaaaattaaagttgagtaccatactggtttttcagatgaaattttcttttcctttttctccttcatattgctcagagcatctaattccatcagaactattgtcaaataaattttatgtaaaatgtgtatttttctaatgggagttgattatacaaactgtattacacctttgtatctgagtgatcatttaaaaatgcatattggtttagcacatagagtttatgaaatgccagataatgctcttattcctcagtgaaatctgcacatttctagttgttggtggtctatttctgtttgctgttccttggaggggggctgagaatgttcaagtttgacttagctgtgtttaagtaataaatctttggagtcaaaaaaaaaaatcggccttcttggcctcagcgggggactctgcggcgtttccttaatgagggt

SEQ ID NO: 72698 - DNA, 1606 bp, Homo sapiens
aatcggcacgaggtgccactagccggcctcggctgttccctgtccgaggctcttgtcatttccgcttatttcctccacgggtgccgatttcatgtgtgtgttcccgagtgcctgagcccgctcccgaaatgagtactcgtggtttccgcgtgggaaccaacctcgagcgccagtggcccgccctctccgggctgaggtggctgctgaggctggggctgctcctgaggcttcagggccgcccgctgcacggctttctaccttcccaggttagccgcggtcaacttctgccaggcggagcgagaaatcgcattttgtcaggggctgcagcatgctgaaagaaaacagaagcctgtggagtgagccaagatcaaccaggaaataaaccctttcccttgcgatgtctctccagcgccctctactgacaaacctgctttagtgccagtttgtagagaattgtctttgctgatctctttattatgatgaaaattctctggatggaagggtcatcagctgccgtctcctttgctactctgctacatatccttacaatttggtttagaattttagtaccactaacattttttggtgcatattttggaaataaagaaaagattagttgtccagttcagacaaaccagatcccctgtcagattcctccatagaacttctttacaaaaccacttcttggcatcataattggtggcattttccccttcggctgtatttttattcaactctttttcattctgaacagtatttggaaaagccttagttgcataagtggaattccttttcacatttgagaaacagaggagagacagttggatttttttcctgtttctggttaattgctaaaatctacagtgtgctgaaggtggagtaaagtatttccccaaaggattccaagcacatctcccttgcccttgaatatctgtatatctatatgaacatcaattgagatatatatgtgtgtgcccctaattacataattttaagcatatatataaaaatgtaaaatctcattgtctggcctcagtttgtatgacacaaaatactgattgtatggaagaaaacagattgggaaacagatttattctatatcatattttcctgaaaagctaccttaaaaagatttaaattaaagcaattagagcaagggaggcacatttctttaaaaaattaaagttgagtaccatactggtttttcagatgaaattttcttttcctttttctccttcatattgctcagagcatctaattccatcagaactattgtcaaataaattttatgtaaaatgtgtatttttctaatgggagttgattatacaaactgtattacacctttgtatctgagtgatcatttaaaaatgcatattggtttagcacatagagtttatgaaatgccagataatgctcttattcctcagtgaaatctgcacatttctagttgttggtggtctatttctgtttgctgttccttggaggggggctgagaatgttcaagtttgacttagctgtgtttaagtaataaatctttggagtcaaaaaaaaaaatcggccttcttggcctcagcgggggactctgcggcgtttccttaatgagggt

SEQ ID NO: 72699 - DNA, 1781 bp, Homo sapiens
ggaggaatgaacgactccagacacaccgccttaagatctgtgacactcaccgcgaaggtctgcagcttcattcctgatccagcgagaccatgaacccaccagaaggaaaaaactccggacacatccgaacgtctagaagaaacaaactccagacacaccgcctgtaagaactgtaacggtcaccgcgagggtccgcggtttcattcttgaagtcagtgagaccaagaacccaccatttctggacacactaccatgccagagatccaggggctgcagcatgctgaaagaaaacagaagcctgtggagtgagccaagatcaaccaggaaataaaccctttcccttgcgatgtctctccagcgccctctactgacaaacctgctttagtgccagtttgtagagaattgtctttgctgatctctttattatgatgaaaattctctggatggaagggtcatcagctgccgtctcctttgctactctgctacatatccttacaatttggtttagaattttagtaccactaacattttttggtgcatattttggaaataaagaaaagattagttgtccagttcagacaaaccagatcccctgtcagattcctccatagaacttctttacaaaaccacttcttggcatcataattggtggcattttccccttcggctgtatttttattcaactctttttcattctgaacagtatttggtctcattagctgtactacatgtttggcttccttttcttagtctttataattcttgtgattacttgctcagaagttacagttttgctgtattattttcatttatgtgctgaggattatcattggtggtggcgatttttaaccagaagctttatagctgtttatctttttacgtatgcagttcattacttctctgccaaacttcaaatcacagaaattgcgagctctattttgtactttgggtacatgatgatcattgtgttgattttcttccttttcatagagacagttggatttttttcctgtttctggttaattgctaaaatctacagtgtgctgaaggtggagtaaagtatttccccaaaggattccaagcacatctcccttgcccttgaatatctgtatatctatatgaacatcaattgagatatatatgtgtgtgcccctaattacataattttaagcatatatataaaaatgtaaaatctcattgtctggcctcagtttgtatgacacaaaatactgattgtatggaagaaaacagattgggaaacagatttattctatatcatattttcctgaaaagctaccttaaaaagatttaaattaaagcaattagagcaagggaggcacatttctttaaaaaattaaagttgagtaccatactggtttttcagatgaaattttcttttcctttttctccttcatattgctcagagcatctaattccatcagaactattgtcaaataaattttatgtaaaatgtgtatttttctaatgggagttgattatacaaactgtattacacctttgtatctgagtgatcatttaaaaatgcatattggtttagcacatagagtttatgaaatgccagataatgctcttattcctcagtgaaatctgcacatttctagttgttggtggtctatttctgtttgctgttccttggaggggggctgagaatgttcaagtttgacttagctgtgtttaagtaataaatctttggagtcaaaaaaaaaaatcggccttcttggcctcagcgggggactctgcggcgtttccttaatgagggt

SEQ ID NO: 72700 - DNA, 1360 bp, Homo sapiens
ggaggaatgaacgactccagacacaccgccttaagatctgtgacactcaccgcgaaggtctgcagcttcattcctgatccagcgagaccatgaacccaccagaaggaaaaaactccggacacatccgaacgtctagaagaaacaaactccagacacaccgcctgtaagaactgtaacggtcaccgcgagggtccgcggtttcattcttgaagtcagtgagaccaagaacccaccatttctggacacactaccatgccagagatccaggggctgcagcatgctgaaagaaaacagaagcctgtggagtgagccaagatcaaccaggaaataaaccctttcccttgcgatgtctctccagcgccctctactgacaaacctgctttagtgccagtttgtagaggattatcattggtggtggcgatttttaaccagaagctttatagctgtttatctttttacgtatgcagttcattacttctctgccaaacttcaaatcacagaaattgcgagctctattttgtactttgggtacatgatgatcattgtgttgattttcttccttttcatagagacagttggatttttttcctgtttctggttaattgctaaaatctacagtgtgctgaaggtggagtaaagtatttccccaaaggattccaagcacatctcccttgcccttgaatatctgtatatctatatgaacatcaattgagatatatatgtgtgtgcccctaattacataattttaagcatatatataaaaatgtaaaatctcattgtctggcctcagtttgtatgacacaaaatactgattgtatggaagaaaacagattgggaaacagatttattctatatcatattttcctgaaaagctaccttaaaaagatttaaattaaagcaattagagcaagggaggcacatttctttaaaaaattaaagttgagtaccatactggtttttcagatgaaattttcttttcctttttctccttcatattgctcagagcatctaattccatcagaactattgtcaaataaattttatgtaaaatgtgtatttttctaatgggagttgattatacaaactgtattacacctttgtatctgagtgatcatttaaaaatgcatattggtttagcacatagagtttatgaaatgccagataatgctcttattcctcagtgaaatctgcacatttctagttgttggtggtctatttctgtttgctgttccttggaggggggctgagaatgttcaagtttgacttagctgtgtttaagtaataaatctttggagtcaaaaaaaaaaatcggccttcttggcctcagcgggggactctgcggcgtttccttaatgagggt

SEQ ID NO: 72701 - DNA, 846 bp, Homo sapiens
  misc_feature (20)..(20): n is a, c, g, or t
  misc_feature (23)..(23): n is a, c, g, or t
  misc_feature (31)..(32): n is a, c, g, or t
ttgtctttttatttttgggnggntttgaaannttgtcgtctcgcatcgctgggtcagacagttggatttttttcctgtttctggttaattgctaaaatctacagtgtgctgaaggtggagtaaagtatttccccaaaggattccaagcacatctcccttgcccttgaatatctgtatatctatatgaacatcaattgagatatatatgtgtgtgcccctaattacataattttaagcatatatataaaaatgtaaaatctcattgtctggcctcagtttgtatgacacaaaatactgattgtatggaagaaaacagattgggaaacagatttattctatatcatattttcctgaaaagctaccttaaaaagatttaaattaaagcaattagagcaagggaggcacatttctttaaaaaattaaagttgagtaccatactggtttttcagatgaaattttcttttcctttttctccttcatattgctcagagcatctaattccatcagaactattgtcaaataaattttatgtaaaatgtgtatttttctaatgggagttgattatacaaactgtattacacctttgtatctgagtgatcatttaaaaatgcatattggtttagcacatagagtttatgaaatgccagataatgctcttattcctcagtgaaatctgcacatttctagttgttggtggtctatttctgtttgctgttccttggaggggggctgagaatgttcaagtttgacttagctgtgtttaagtaataaatctttggagtcaaaaaaaaaaatcggccttcttggcctcagcgggggactctgcggcgtttccttaatgagggt

SEQ ID NO: 72702 - DNA, 971 bp, Homo sapiens
ggaggaatgaacgactccagacacaccgccttaagatctgtgacactcaccgcgaaggtctgcagcttcattcctgatccagcgagaccatgaacccaccagaaggaaaaaactccggacacatccgaacgtctagaagaaacaaactccagacacaccgcctgtaagaactgtaacggtcaccgcgagggtccgcggtttcattcttgaagtcagtgagaccaagaacccaccatttctggacacactaccatgccagagatccaggggctgcagcatgctgaaagaaaacagaagcctgtggagtgagccaagatcaaccaggaaataaaccctttcccttgcgatgtctctccagcgccctctactgacaaacctgctttagtgccagtttgtagagaattgtctttgctgatctctttattatgatgaaaattctctggatggaagggtcatcagctgccgtctcctttgctactctgctacatatccttacaatttggtttagaattttagtaccactaacattttttggtgcatattttggaaataaagaaaagattagttgtccagttcagacaaaccagatcccctgtcagattcctccatagaacttctttacaaaaccacttcttggcatcataattggtggcattttccccttcggctgtatttttattcaactctttttcattctgaacagtatttggaaaagccttagttgcataagtggaattccttttcacatttgagaaacagaggagagacagttggatttttttcctgtttctggttaattgctaaaatctacagtgtgctgaaggtggagtaaagtatttccccaaaggattccaagcacatctcccttgcccttgaatatctgtatatctatatgaacatcaattgagatatatatgtgtgtgcccctaattacataattttaagcatatatataaaaatgtaaaatctca

SEQ ID NO: 72703 - DNA, 1465 bp, Homo sapiens
ggaggaatgaacgactccagacacaccgccttaagatctgtgacactcaccgcgaaggtctgcagcttcattcctgatccagcgagaccatgaacccaccagaaggaaaaaactccggacacatccgaacgtctagaagaaacaaactccagacacaccgcctgtaagaactgtaacggtcaccgcgagggtccgcggtttcattcttgaagtcagtgagaccaagaacccaccatttctggacacactaccatgccagagatccaggggctgcagcatgctgaaagaaaacagaagcctgtggagtgagccaagatcaaccaggaaataaaccctttcccttgcgatgtctctccagcgccctctactgacaaacctgctttagtgccagtttgtagagaattgtctttgctgatctctttattatgatgaaaattctctggatggaagggtcatcagctgccgtctcctttgctactctgctacatatccttacaatttggtttagaattttagtaccactaacattttttggtgcatattttggaaataaagaaaaggtaaactcttaaaatactgcttttggccactgagcgatgactgaaataatacctcagtgtatatattacacatgaaatacaaaaagtcccactggagaaaactacagagaataatcattttggaataaaagatactttaaaaaattaagtaaaggacagtaacactttcaaagacattaatgcatttcctacattatcaattgtttatactgccttttacctctgatgaaccaaattaaaaggacatattgtagaaaggctgacatcagccaactcaggaaactaatagggttatacagtgggataaggaagtcaagatgtagtccaaggaatggggctattcggtttacagatttgaagttagcctattccacatatcggagaaaggtataggataccaaaaagtctcaatgaggccacacagccaaaaaactcttcaaggatatagcatgagattgcagaggaaatgttggaaaagacaaaatgggaggtggagttccacagagagcagcaaaaagaaaattttctgaaaactatttgacacattcttagacaattctaagagagaacttttggacattttagattattttgcattagaatagtcactggtaaatctttccagtctctcccttggaaattataaaaaaggataaatatcctcattgattgtttagctgtgtgtcacttagtatggtgccactggtcgcatgtggctgttgagcacctgaaatgtggctgtcggaattgagatgggctctatgtggaaaatacacaccagattttgaacacttagaacaacgacaaagataacgtaaaatatttgctcaataattttatattaacacaagtataaatcataatatttggacatgttagaataaataaaatatgatgttaaaatt

SEQ ID NO: 72704 - DNA, 930 bp, Homo sapiens
ggaggaatgaacgactccagacacaccgccttaagatctgtgacactcaccgcgaaggtctgcagcttcattcctgatccagcgagaccatgaacccaccagaaggaaaaaactccggacacatccgaacgtctagaagaaacaaactccagacacaccgcctgtaagaactgtaacggtcaccgcgagggtccgcggtttcattcttgaagtcagtgagaccaagaacccaccatttctggacacactaccatgccagagatccaggggctgcagcatgctgaaagaaaacagaagcctgtggagtgagccaagatcaaccaggaaataaaccctttcccttgcgatgtctctccagcgccctctactgacaaacctgctttagtgccagtttgtagagaattgtctttgctgatctctttattatgatgaaaattctctggatggaagggtcatcagctgccgtctcctttgctactctgctacatatccttacaatttggtttagaattttagtaccactaacattttttggtgcatattttggaaataaagaaaagattagttgtccagttcagacaaaccagatcccctgtcagattcctccatagaacttctttacaaaaccacttcttggcatcataattggtggcattttccccttcggctgtatttttattcaactctttttcattctgaacagtatttggtctcattagctgtactacatgtttggcttccttttcttagtctttataattcttgtgattacttgctcagaagttacagttttgctgtattattttcatttatgtgctgaggtaaagccataagaaactaatgcatttgctatacttgcattattggaattggaagtctgtgtttagaaaagaattgaaataaatgataactgcatgtttctacaacttg

SEQ ID NO: 72705 - DNA, 658 bp, Homo sapiens
aatcggcacgaggtgccactagccggcctcggctgttccctgtccgaggctcttgtcatttccgcttatttcctccacgggtgccgatttcatgtgtgtgttcccgagtgcctgagcccgctcccgaaatgagtactcgtggtttccgcgtgggaaccaacctcgagcgccagtggcccgccctctccgggctgaggtggctgctgaggctggggctgctcctgaggcttcagggccgcccgctgcacggctttctaccttcccaggttagccgcggtcaacttctgccaggcggagcgagaaatcgcattttgtcaggggctgcagcatgctgaaagaaaacagaagcctgtggagtgagccaagatcaaccaggaaataaaccctttcccttgcgatgtctctccagcgccctctactgacaaacctgctttagtgccagtttgtagagagacagttggatttttttcctgtttctggttaattgctaaaatctacagtgtgctgaaggtggagtaaagtatttccccaaaggattccaagcacatctcccttgcccttgaatatctgtatatctatatgaacatcaattgagatatatatgtgtgtgcccctaattacataattttaagcatatatataaaaatgtaaaatctca

SEQ ID NO: 72706 - DNA, 1112 bp, Homo sapiens
aaattagccaggtgtggtgatgtgcacctgtagttccagctactcaggagggtgaggcaggaggatcacttgagcccagaagttcaagattgcaatgagctatgatcatgctactgcactccagcctaggcaacagagtgagaccctgtctctaaaaaaataaaaataaagcaagcatataataggttaatccagatggagttaggagggtttataagggcagacacatcctagtaaagaggaaataggcaaactaatgctgttttagtgtaataaggaatgcttataatgatgaactttagtcataaagaaaaggtgaaattatattcagtaacccatgttaggaaagcagaaaactatttaatatgcttggaaagattccaaccagagttaactgaataaaaaccttggacatttgaagagaaaagcatttagttctatctaatttcaatatgcacgtgaattagttcatgttactctaacaatgtattcttactgtccttttttatgaaataggaaagtaaaactgaaagaactatttcttgtgtttttaaaactagccttttctaatatttgatatctaattaaagttagataatatgtaatatgcttttgaacaataatctaaccagaaaatattgtataataaattaccaagaaatcattacattaattataaaaggaacatgtcaatacaacaaatgtttatttaacacctactgttactccaaatactgtgttagaatttgactattcgaagatgaataatagtctttgccctctggaaggccacaatgtagaagtaattctctgtatcagatatttccttgagtgttaagtgtattagtaatcatgttgtaaatcccagtgtaagtcaagaagcaatatcaccaccaccacctccctatgattttgtgataatttggcattttcaatgcttgttaactttcatgttttcatttttatgaaatcatgcagagcttgttataatttttagtggggtttggattaaaatgcttttttgatgtagcagaagatacattttttcccattttacattgttttccttaaatattaagaataatgagtaaaataaactgattttaaaatca

SEQ ID NO: 72707 - DNA, 931 bp, Homo sapiens
  misc_feature (826)..(826): n is a, c, g, or t
  misc_feature (835)..(835): n is a, c, g, or t
aaattagccaggtgtggtgatgtgcacctgtagttccagctactcaggagggtgaggcaggaggatcacttgagcccagaagttcaagattgcaatgagctatgatcatgctactgcactccagcctaggcaacagagtgagaccctgtctctaaaaaaataaaaataaagcaagcatataataggttaatccagatggagttaggagggtttataagggcagacacatcctagtaaagaggaaataggcaaactaatgctgttttagtgtaataaggaatgcttataatgatgaactttagtcataaagaaaaggtgaaattatattcagtaacccatgttaggaaagcagaaaactatttaatatgcttggaaagattccaaccagagttaactgaataaaaaccttggacatttgaagagaaaagcatttagttctatctaatttcaatatgcacgtgaattagttcatgttactctaacaatgtattcttactgtccttttttatgaaataggaaagtaaaactgaaagaactatttcttgtgtttttaaaactagccttttctaatatttgatatctaattaaagttagataatatgtaatatgcttttgaacaataatctaaccagaaaatattgtataataaattaccaagaaatcattacattaattataaaaggaacatgtcaatacaacaaatgtttatttaacacctactgttactccaaatactgtgttagaatttgactattcgaagatgaataatagtctttgccctctggaaggccacaatgtagaagtaattctctgtatcagatattcntgaggtagngtttagcacctcgtgtaacccccgtgtcgaaggatttcccaccctccttttgggaatggctcagccgggcacagttttttaaaagcaggcaacagg

SEQ ID NO: 72708 - DNA, 129 bp, Homo sapiens
tcttcacactggtccccatcccagtggaacaagcaatgccaatgtaccaagtgcaattccagattgtaagtttgaaatgtcattgccagccattacagaagaggcaaaagtccacagtgggtgtatgcc

SEQ ID NO: 72709 - DNA, 454 bp, Homo sapiens
atggcttgaacctgggaggtggaggttgcagtgagctgagatcgcaccactgcactaaaaaaaagaaaaagaaagaaaaagaaaataaaagaacaaaggttttctgagctttaagtatgaagctccatgggctcagaagaatgaaagcactttgaaataactcagaaacagaaagtcaaacactgcatgttctttctcccttataagtaggggggtaagcaatgggtacatgtggacagacagagcagaatagtagacattggagacttcaaaaggtgggaggataggtgagagatgaaaaattacctattgggtaccatgtacactattcgggtgatgggtactctaaaagcccaggcttcaccactgcacagtatatccacgaaacaaaactgcacttgtaccccctgaatctataaaattaatacaaataaaaaagattgaaggcacctgt

SEQ ID NO: 72710 - DNA, 395 bp, Homo sapiens
cctttagttaaaaggtgaaagttctcaagaaaaaaaaaagtatgctgagattgctaagatctacagtaagaatcaatcttctatccatgaaattgtgaaaaaggacaaagaaatttgtgctagttttgctgctgtacctaaaactacaaaagttacagccacagtgtgggctaagtgccgagctgaaatggaaaaggcattaaaggcaagcgtatacagggttcggtcccatccgcagtcttaggcatcccctggggattttgacatggatcccccgtggagaaggggggctactgtacagtacacttcccttcagcaagccgcatattcaagttctctatttcagattccccttcgtgactgtcatgcaggaagcaaagaaaacccattgtgtc

SEQ ID NO: 72711 - DNA, 387 bp, Homo sapiens
cctttagttaaaaggtgaaagttctcaagaaaaaaaaaagtatgctgagattgctaagatctacacctaatgaggaggtgactatcatgaaggtctggtggtgaagatcttgcaagaaggtgccttgtttgagatctttcaaggaaacacagtactcaataaatgtggttcggtgtacagttgagccttgagcaacatggatttgaactgcatggggccacttaaatgtgcattttcttatgactccgctgctcttgagacagcaagatcaagccccctcctcctcagccaactcaacgtgaagacaatgaagatcaagatctttaagatgatccacttccacttaatgaataataaatatattttgtcgttatgattttcctaaca

SEQ ID NO: 72712 - DNA, 527 bp, Homo sapiens
cctttagttaaaaggtgaaagttctcaagaaaaaaaaaagtatgctgagattgctaagatctacagtaagaatcaatcttctatccatgaaattgtgaaaaaggacaaagaaatttgtgctagttttgctgctgtacctaaaactacaaaagttacagccacagtgtgggctaagtgccgagctgaaatggaaaaggcattaaagcctaatgaggaggtgactatcatgaaggtctggtggtgaagatcttgcaagaaggtgccttgtttgagatctttcaaggaaacacagtactcaataaatgtggttcggtgtacagttgagccttgagcaacatggatttgaactgcatggggccacttaaatgtgcattttcttatgactccgctgctcttgagacagcaagatcaagccccctcctcctcagccaactcaacgtgaagacaatgaagatcaagatctttaagatgatccacttccacttaatgaataataaatatattttgtcgttatgattttcctaaca

SEQ ID NO: 72713 - DNA, 485 bp, Homo sapiens
gaatcgacatgagaagtaatacttggaagtgttctgagaaatgatgaaaaaagggcctggtttctatctgattgaaaggaggtgagacttgggagagcagtcagactccctctctccttctcacctcttctcctcatcccctcccctaagtgctctggctaggaattctagtacaatgttacgtagaagtgggcttttcttgccctggcgtggtggctcacacctgtaatcccagcactttgggatccgaggtgtatggatcatgagatcaggagtttgagaccagcctagtcaatatggtgaaatcccatctctaccaaaaatacaaaaattagctggatgtggtaacatgcacctgtaatcccagctactcaggaggctgaggcaggagaatcgcttgaaccctgtggtggaggttgcagtgagccgagatcacgccattgcacttcagcctgggtgacatagtgagactctgtccccccacc

SEQ ID NO: 72714 - DNA, 450 bp, Homo sapiens
ctcccgaaattctggaattagaggtgtgagctacctcgcccagccctcttttaagtttttgtttatctgggaatgtcttaatttctccttaaggctagttttgctggatgtagaattcttggtttatagtctttgtctcatcatttcgaatatgtcctcccaccactttctggcctctggtttctactgagaagccaactagtttctgataaggatcctttgtacacactgagtcatttttctgtcactgctttcaagattttgtggcttttgacagtttcgattatgatgtgtctatgtgtggatctctgagtttatcctacatggagtttgttgagcttcttggaggtgcagaataattcatattttggggaagttttcaacaagtttgggaaggttttggccatgtttctttctgcctcatttctctctgctctccttctgacacta

SEQ ID NO: 72715 - DNA, 385 bp, Homo sapiens
tgtgttaattttgcttgttacaagtgacagaaatgcaattcaaatttatgtgtgccaaaaaggaatttattgactcatgtacctaagaaaatcaagagatgtattagtttcttgcatgactagctgcagagctttaaacagtatcatctgcagaacatctgtcttctctggctcttaactctactttctttgtgtcggttttattcccaagcagctgctccctagctgtggctggtaatggtttgtgttctcccagcttaacaatcccagaggaaaaacacctctttcccagttttgtggtttcagcaaaagtggttggtcttactggcctggtgtgagtcacatgccattcctaaggcagtcactatggcaagggggatggaat

SEQ ID NO: 72716 - DNA, 377 bp, Homo sapiens
gacatggaaacatctatcccctgacagccatcctattatgggcaggaactccatcttacacttgtttatattcttgatgacacctaatgtctcttaaaatatgtgtctcttaaaaactactcggtggccttagccatttggggagattataggcaaactgagtccattagttgactaaggaccaggagaggttcccgccagtgcccgggacttctatttgagcacgcacaacctcagcagcttagactagaaaactgtagacacagattccctggtgtatcccttcctgggccttcactctgaatgttggattcctctctagggaggctgtcatgactgcaaagcctttccccagtcagctcagcttctatgtcagc

SEQ ID NO: 72717 - DNA, 784 bp, Homo sapiens
gcacatatgtgtcatgtccctctggtctggaaggcgtgtagtgtctgagccccactgctgtcccctgcttaccacccaacactgagaaaatcaaactgggccacgtgcccacttgctgccttccttgcagctgagtccctaggcaaggaggccctggatgggggtggccgtgtcaccaaatatccgcttccctggtgataggaggtctgtgggccccactcatctcctgtgtgcttcccccctaaccaggagatgcttcagaaggtcgaagttgagtatgaaacgctgcctgggtggaaagcagacaccacaggcgccaggaggtgggaggacctgcccccacaggcccagaactacatccgctttgtggagaatcacgtgggagtcgcagtgtgtatcataacagtcttttctgctctctcagtcaaatgggttggtgttggcaagtcaagagagtcgatgatccagctgttttagtcgcagactgagctgatcccaacaggccctggcagcgtctggacttgtgtaaacagcagcagtcacgttcctcggccgccacaaccaacaccaaagcaggaaaaccattttctgtacttttatatttctgttcaacctgttggtttctacaatgattttaaacattggaaagccagccttgtgtatatttttaaaaattatattcaaaatgagccaaagtgctcagagaccttctatgacacattagtgtcacatggttgcgtgtccagccgaagcagtgtaataaacatctccaatggccactgaa

SEQ ID NO: 72718 - DNA, 648 bp, Homo sapiens
gcacatatgtgtcatgtccctctggtctggaaggcgtgtagtgtctgagccccactgctgtcccctgcttaccacccaacactgagaaaatcaaactgggccacgtgcccacttgctgccttccttgcagctgagtccctaaccaggagatgcttcagaaggtcgaagttgagtatgaaacgctgcctgggtggaaagcagacaccacaggcgccaggaggtgggaggacctgcccccacaggcccagaactacatccgctttgtggagaatcacgtgggagtcgcagtcaaatgggttggtgttggcaagtcaagagagtcgatgatccagctgttttagtcgcagactgagctgatcccaacaggccctggcagcgtctggacttgtgtaaacagcagcagtcacgttcctcggccgccacaaccaacaccaaagcaggaaaaccattttctgtacttttatatttctgttcaacctgttggtttctacaatgattttaaacattggaaagccagccttgtgtatatttttaaaaattatattcaaaatgagccaaagtgctcagagaccttctatgacacattagtgtcacatggttgcgtgtccagccgaagcagtgtaataaacatctccaatggccactgaa

SEQ ID NO: 72719 - DNA, 681 bp, Homo sapiens
gcacatatgtgtcatgtccctctggtctggaaggcgtgtagtgtctgagccccactgctgtcccctgcttaccacccaacactgagaaaatcaaactgggccacgtgcccacttgctgccttccttgcagctgagtccctaaccaggagatgcttcagaaggtcgaagttgagtatgaaacgctgcctgggtggaaagcagacaccacaggcgccaggaggtgggaggacctgcccccacaggcccagaactacatccgctttgtggagaatcacgtgggagtcgcagtcaaatgggttggtgttggcaagtcaagagagtcgatgatccagctgttttagtcgcagactgagctgatcccaacaggccctggcagcgtctggacttgtgtaaacagcagcagtcacgttcctcggccgccacaaccaacaccaaagcaggaaaaccattttctgtacttttatatttctgttcaacctgttggtttctacaatgattttaaacattggaaagccagccttgtgtatatttttaaaaattatattcaaaatgagccaaagtgctcagagaccttctatgacacattagtgtcacatggttgcgtgtccagccgaagcagtgtaataaacatctccaatggccactgaatgggagcagttgttacatgtttgatttgacttt

SEQ ID NO: 72720 - DNA, 1737 bp, Homo sapiens
acgccggcggcggcgggctcctggccgggccagcgcagcggaagagccaagccagcatgtcggggacccgagcctccaacgaccggccccccggcgcaggcggcgtcaagcgggggcggctgcagcaggaggcggcggcgaccggctcccgcgtgacggtggtgctgggcgcgcagtggggggacgagggcaaaggcaaggtggtggacctgctggccacggacgccgacatcatcagccgctgccaggggggcaacaacgccggccacacggtggtggtggatgggaaagagtacgacttccacctgctgcccagcggcatcatcaacaccaaggccgtgtccttcattggcaacggggtggtcatccacttgccaggcttgtttgaggaagcagagaagaatgaaaagaaaggcctgaaggactgggagaagaggctcatcatctctgacagagcccaccttgtgtttgattttcaccaggctgtcgacggacttcaggaagtgcagcgccaggcacaagaggggaagaatataggcaccaccaagaagggaatcggaccaacctactcttccaaagctgcccggacaggcctccgcatctgcgacctcctgtcagattttgatgagttttcctccagattcaagaacctggcccaccagcaccagtcgatgttccccaccctggaaatagacattgaaggccaactcaaaaggctcaagggctttgctgagcggatcagacccatggtccgagatggtgtttactttatgtatgaggcactccacggcccccccaagaagatcctggtggagggtgccaacgccgccctcctcgacattgacttcgggacctacccctttgtgacttcatccaactgcaccgtgggcggtgtgtgcacgggcctgggcatccccccgcagaacataggtgacgtgtatggcgtggtgaaagcctataccacacgtgtgggcatcggggccttccccaccgagcagatcaacgagattggaggcctgctgcagacccgcggccacgagtggggagtgaccacaggcaggaagaggcgctgcggctggctcgacctgatgattctaagatatgctcacatggtcaacggattcactgcgctggccctgacgaagctggacatcctggacgtactgggtgaggttaaagtcggtgtctcatacaagctgaacgggaaaaggattccctatttcccagctaaccaggagatgcttcagaaggtcgaagttgagtatgaaacgctgcctgggtggaaagcagacaccacaggcgccaggaggtgggaggacctgcccccacaggcccagaactacatccgctttgtggagaatcacgtgggagtcgcagtcaaatgggttggtgttggcaagtcaagagagtcgatgatccagctgttttagtcgcagactgagctgatcccaacaggccctggcagcgtctggacttgtgtaaacagcagcagtcacgttcctcggccgccacaaccaacaccaaagcaggaaaaccattttctgtacttttatatttctgttcaacctgttggtttctacaatgattttaaacattggaaagccagccttgtgtatatttttaaaaattatattcaaaatgagccaaagtgctcagagaccttctatgacacattagtgtcacatggttgcgtgtccagccgaagcagtgtaataaacatctccaatggccactgaa

SEQ ID NO: 72721 - DNA, 1821 bp, Homo sapiens
agcggggcggcatggtagggaggagctgtggggtggcaacccagaggcaaggaggtgggcagaggcccacgaacctggccctgaccctcagctcgtccccagctcacagcacagccctcccctggctgcctccaaggagtctccagctactgagtggccactccgtgccagctcagcccacccctcaccttcccagtgcctgtggaggcccaactagggtgacgctgggagaggagagggcttggaggagccacgggtcaaatgcaggaggccacacctgcctgcccaggaggactgcaggagccggatccttaacacctggaggggagcgggggggcaacaacgccggccacacggtggtggtggatgggaaagagtacgacttccacctgctgcccagcggcatcatcaacaccaaggccgtgtccttcattggcaacggggtggtcatccacttgccaggcttgtttgaggaagcagagaagaatgaaaagaaaggcctgaaggactgggagaagaggctcatcatctctgacagagcccaccttgtgtttgattttcaccaggctgtcgacggacttcaggaagtgcagcgccaggcacaagaggggaagaatataggcaccaccaagaagggaatcggaccaacctactcttccaaagctgcccggacaggcctccgcatctgcgacctcctgtcagattttgatgagttttcctccagattcaagaacctggcccaccagcaccagtcgatgttccccaccctggaaatagacattgaaggccaactcaaaaggctcaagggctttgctgagcggatcagacccatggtccgagatggtgtttactttatgtatgaggcactccacggcccccccaagaagatcctggtggagggtgccaacgccgccctcctcgacattgacttcgggacctacccctttgtgacttcatccaactgcaccgtgggcggtgtgtgcacgggcctgggcatccccccgcagaacataggtgacgtgtatggcgtggtgaaagcctataccacacgtgtgggcatcggggccttccccaccgagcagatcaacgagattggaggcctgctgcagacccgcggccacgagtggggagtgaccacaggcaggaagaggcgctgcggctggctcgacctgatgattctaagatatgctcacatggtcaacggattcactgcgctggccctgacgaagctggacatcctggacgtactgggtgaggttaaagtcggtgtctcatacaagctgaacgggaaaaggattccctatttcccagctaaccaggagatgcttcagaaggtcgaagttgagtatgaaacgctgcctgggtggaaagcagacaccacaggcgccaggaggtgggaggacctgcccccacaggcccagaactacatccgctttgtggagaatcacgtgggagtcgcagtcaaatgggttggtgttggcaagtcaagagagtcgatgatccagctgttttagtcgcagactgagctgatcccaacaggccctggcagcgtctggacttgtgtaaacagcagcagtcacgttcctcggccgccacaaccaacaccaaagcaggaaaaccattttctgtacttttatatttctgttcaacctgttggtttctacaatgattttaaacattggaaagccagccttgtgtatatttttaaaaattatattcaaaatgagccaaagtgctcagagaccttctatgacacattagtgtcacatggttgcgtgtccagccgaagcagtgtaataaacatctccaatggccactgaa

SEQ ID NO: 72722 - DNA, 1807 bp, Homo sapiens
acgccggcggcggcgggctcctggccgggccagcgcagcggaagagccaagccagcatgtcggggacccgagcctccaacgaccggccccccggcgcaggcggcgtcaagcgggggcggctgcagcaggaggcggcggcgaccggctcccgcgtgacggtggtgctgggcgcgcagtggggggacgagggcaaaggcaaggtggtggacctgctggccacggacgccgacatcatcagccgctgccaggggggcaacaacgccggccacacggtggtggtggatgggaaagagtacgacttccacctgctgcccagcggcatcatcaacaccaaggccgtgtccttcattggcaacggggtggtcatccacttgccaggcttgtttgaggaagcagagaagaatgaaaagaaaggcctgaaggactgggagaagaggctcatcatctctgacagagcccaccttgtgtttgattttcaccaggctgtcgacggacttcaggaagtgcagcgccaggcacaagaggggaagaatataggcaccaccaagaagggaatcggaccaacctactcttccaaagctgcccggacaggcctccgcatctgcgacctcctgtcagattttgatgagttttcctccagattcaagaacctggcccaccagcaccagtcgatgttccccaccctggaaatagacattgaaggccaactcaaaaggctcaagggctttgctgagcggatcagacccatggtccgagatggtgtttactttatgtatgaggcactccacggcccccccaagaagatcctggtggagggtgccaacgccgccctcctcgacattgacttcgggacctacccctttgtgacttcatccaactgcaccgtgggcggtgtgtgcacgggcctgggcatccccccgcagaacataggtgacgtgtatggcgtggtgaaagcctataccacacgtgtgggcatcggggccttccccaccgagcagatcaacgagattggaggcctgctgcagacccgcggccacgagtggggagtgaccacaggcaggaagaggcgctgcggctggctcgacctgatgattctaagatatgctcacatggtcaacggattcactgcgctggccctgacgaagctggacatcctggacgtactgggtgaggttaaagtcggtgtctcatacaagctgaacgggaaaaggattccctatttcccagctaaccaggagatgcttcagaaggtcgaagttgagtatgaaacgctgcctgggtggaaagcagacaccacaggcgccaggaggtgggaggacctgcccccacaggcccagaactacatccgctttgtggagaatcacgtgggagtcgcagtcaaatgggttggtgttggcaagtcaagagagtcgatgatccagctgttttagtcgcagactgagctgatcccaacaggccctggcagcgtctggacttgtgtaaacagcagcagtcacgttcctcggccgccacaaccaacaccaaagcaggaaaaccattttctgtacttttatatttctgttcaacctgttggtttctacaatgattttaaacattggaaagccagccttgtgtatatttttaaaaattatattcaaaatgagccaaagtgctcagagaccttctatgacacattagtgtcacatggttgcgtgtccagccgaagcagtgtaataaacatctccaatggccactgaaaaaaaaccaccacccccgatacccacaccaaaacaaacaccacacaacaaaggggcgcgcggcaaaaacc

SEQ ID NO: 72723 - DNA, 1770 bp, Homo sapiens
acgccggcggcggcgggctcctggccgggccagcgcagcggaagagccaagccagcatgtcggggacccgagcctccaacgaccggccccccggcgcaggcggcgtcaagcgggggcggctgcagcaggaggcggcggcgaccggctcccgcgtgacggtggtgctgggcgcgcagtggggggacgagggcaaaggcaaggtggtggacctgctggccacggacgccgacatcatcagccgctgccaggggggcaacaacgccggccacacggtggtggtggatgggaaagagtacgacttccacctgctgcccagcggcatcatcaacaccaaggccgtgtccttcattggcaacggggtggtcatccacttgccaggcttgtttgaggaagcagagaagaatgaaaagaaaggcctgaaggactgggagaagaggctcatcatctctgacagagcccaccttgtgtttgattttcaccaggctgtcgacggacttcaggaagtgcagcgccaggcacaagaggggaagaatataggcaccaccaagaagggaatcggaccaacctactcttccaaagctgcccggacaggcctccgcatctgcgacctcctgtcagattttgatgagttttcctccagattcaagaacctggcccaccagcaccagtcgatgttccccaccctggaaatagacattgaaggccaactcaaaaggctcaagggctttgctgagcggatcagacccatggtccgagatggtgtttactttatgtatgaggcactccacggcccccccaagaagatcctggtggagggtgccaacgccgccctcctcgacattgacttcgggacctacccctttgtgacttcatccaactgcaccgtgggcggtgtgtgcacgggcctgggcatccccccgcagaacataggtgacgtgtatggcgtggtgaaagcctataccacacgtgtgggcatcggggccttccccaccgagcagatcaacgagattggaggcctgctgcagacccgcggccacgagtggggagtgaccacaggcaggaagaggcgctgcggctggctcgacctgatgattctaagatatgctcacatggtcaacggattcactgcgctggccctgacgaagctggacatcctggacgtactgggtgaggttaaagtcggtgtctcatacaagctgaacgggaaaaggattccctatttcccagctaaccaggagatgcttcagaaggtcgaagttgagtatgaaacgctgcctgggtggaaagcagacaccacaggcgccaggaggtgggaggacctgcccccacaggcccagaactacatccgctttgtggagaatcacgtgggagtcgcagtcaaatgggttggtgttggcaagtcaagagagtcgatgatccagctgttttagtcgcagactgagctgatcccaacaggccctggcagcgtctggacttgtgtaaacagcagcagtcacgttcctcggccgccacaaccaacaccaaagcaggaaaaccattttctgtacttttatatttctgttcaacctgttggtttctacaatgattttaaacattggaaagccagccttgtgtatatttttaaaaattatattcaaaatgagccaaagtgctcagagaccttctatgacacattagtgtcacatggttgcgtgtccagccgaagcagtgtaataaacatctccaatggccactgaatgggagcagttgttacatgtttgatttgacttt

SEQ ID NO: 72724 - DNA, 1770 bp, Homo sapiens
acgccggcggcggcgggctcctggccgggccagcgcagcggaagagccaagccagcatgtcggggacccgagcctccaacgaccggccccccggcgcaggcggcgtcaagcgggggcggctgcagcaggaggcggcggcgaccggctcccgcgtgacggtggtgctgggcgcgcagtggggggacgagggcaaaggcaaggtggtggacctgctggccacggacgccgacatcatcagccgctgccaggggggcaacaacgccggccacacggtggtggtggatgggaaagagtacgacttccacctgctgcccagcggcatcatcaacaccaaggccgtgtccttcattggcaacggggtggtcatccacttgccaggcttgtttgaggaagcagagaagaatgaaaagaaaggcctgaaggactgggagaagaggctcatcatctctgacagagcccaccttgtgtttgattttcaccaggctgtcgacggacttcaggaagtgcagcgccaggcacaagaggggaagaatataggcaccaccaagaagggaatcggaccaacctactcttccaaagctgcccggacaggcctccgcatctgcgacctcctgtcagattttgatgagttttcctccagattcaagaacctggcccaccagcaccagtcgatgttccccaccctggaaatagacattgaaggccaactcaaaaggctcaagggctttgctgagcggatcagacccatggtccgagatggtgtttactttatgtatgaggcactccacggcccccccaagaagatcctggtggagggtgccaacgccgccctcctcgacattgacttcgggacctacccctttgtgacttcatccaactgcaccgtgggcggtgtgtgcacgggcctgggcatccccccgcagaacataggtgacgtgtatggcgtggtgaaagcctataccacacgtgtgggcatcggggccttccccaccgagcagatcaacgagattggaggcctgctgcagacccgcggccacgagtggggagtgaccacaggcaggaagaggcgctgcggctggctcgacctgatgattctaagatatgctcacatggtcaacggattcactgcgctggccctgacgaagctggacatcctggacgtactgggtgaggttaaagtcggtgtctcatacaagctgaacgggaaaaggattccctatttcccagctaaccaggagatgcttcagaaggtcgaagttgagtatgaaacgctgcctgggtggaaagcagacaccacaggcgccaggaggtgggaggacctgcccccacaggcccagaactacatccgctttgtggagaatcacgtgggagtcgcagtgtgtatcataacagtcttttctgctctctcagtcaaatgggttggtgttggcaagtcaagagagtcgatgatccagctgttttagtcgcagactgagctgatcccaacaggccctggcagcgtctggacttgtgtaaacagcagcagtcacgttcctcggccgccacaaccaacaccaaagcaggaaaaccattttctgtacttttatatttctgttcaacctgttggtttctacaatgattttaaacattggaaagccagccttgtgtatatttttaaaaattatattcaaaatgagccaaagtgctcagagaccttctatgacacattagtgtcacatggttgcgtgtccagccgaagcagtgtaataaacatctccaatggccactgaa

SEQ ID NO: 72725 - DNA, 521 bp, Homo sapiens
gcctcccaaataggtgggactagcacctggctaatttttatatattttgtagggacggggttctgttatgttgttcaggctggcctcagacgcctgggcttaagcgatctgcacaccttggcctctcaaagtgctgagattctgtgggattcgcacctggcctaaaacataggtattaatagttatattcaaggtaagaataacattttgaatatttgaaaaggtgttgaacactaataattttggaaagccttttctacaaaattttgaggaaaggaagaaaaagaagttttggcagaaagataaggaatgccagaatacactgattaaattcttagaacctataccaaaatattaaaaatttttcctaaagtaaaatttgacattctgtggtttggagagtttaactttaggagtaatttataacagaatcatatatatgaaaaatttttatcttgattttcagtttttgcagagtgctttgaaggtaatacattgctgtctgaaggagtgttgttttg

SEQ ID NO: 72726 - DNA, 253 bp, Homo sapiens
cagaaaacaggggggagtccttcacccttcccactacaacagcccacttccagtcacaagcatgccaatttcgactcctcactatttcctgatacagcctttctggccacgttcatggcaccctccatgtgcacaacaccacaatcccatctacctgagtgcaatctcctggtgggactccctggctgcagtcttgcacctctctaatttatcctctgtaccatagtcaacatgaccctgccaaaacccaaat

SEQ ID NO: 72727 - DNA, 1542 bp, Homo sapiens
  misc_feature (199)..(199): n is a, c, g, or t
  misc_feature (310)..(310): n is a, c, g, or t
  misc_feature (531)..(531): n is a, c, g, or t
  misc_feature (749)..(749): n is a, c, g, or t
cagaaatcatctccttgctttgcattctttgcctgcaggacacggcaacatttcacccccttgtgagccttcgggatgattttacacgtgagggagggatctgtaaccattagcaattctttattatcaaagacacaactttacatatacattcacataggcctagcagggccccctggcctgcaggtggcacaggacngggcatgtgctgactccacactgaatccccacatctcctgcatggcatggcttagcacacctgtgtttgaaaactcaggttcgtttcctcaatgtttttcacgtcatcaanggcatagctccttagacccaaaagctgtgcctttgcctgacccggcgtaagaagcctatgcacttcctgatatgttttctcctctgtttgcttctaatgtctccggatgaaatcattgagtcatttttaatcactgtaaaacatcagagaattaacttggaaaacatgggaagaccttggtgaaaaaggaaatcctatgaagtgtaaagaatttttgagcnaaaatgagtgagactattaatgtttgaaaatgatgaacttggcagaaacactacaacattttcatttttaacagcattatcagaaacacactctgaaaacatgcacagaactcaggaccttactgtgaataaagctgaaattgagcaaaggcatttataccctcaggagggatttcttcagcgttttaaattgttttttctttcttcctagtaagtcntgagttcaagatttactacaacaaaactaactcatgcagaactgtacacccctgtcataatttcaaactgcccgtgagataccaggtgtgtctgcggtacatatgagcgtgcttgtatgcacaaccgaattataatttagttcaagaagacatgacttcaatccccagcaaagagttttcagctgctgtaggttgtctgtcttgctctgtttgggtttttaaggttggagcgtctccaggatcattgtttaaataagactgtgctcagactcaactttcagctttttctgtaaagggagtcgagatgaggctgtgggcaccgaatgtcatgaatcaggagacggtcggtgacctcgggccggttctagaagcccaatgccagtgcaaagaggaaagagcaggaaagagatggccttttccatgcagccatttctttctcacttcccaacggttcacatgaacgacgccggaagcccacggagactccactctcccaacagtcgacttctgaatctgatttttaaaatgccaacagcttccactctcccagctgatttaaaaaaaaaaattattataatcaatgtgcttgaatcctgcacacactcctatccagtgagggacgctcaatggtgctgctggggccaatctgagaccacagcaaaacagccattgtcctgagaatgttttatgacgtaacgatatggtgtcttttacatacttttttctgttctggaaataagggaaattgaaattggtttctaattaacttaagttcttcaccaacctcagtatc

SEQ ID NO: 72728 - DNA, 3535 bp, Homo sapiens
cgggagcggaccgtaagcccggcagcccgagaggaagatgaacagccccaggcagagcctctcggagagtggaccccgagccgcccccaggtagccaggagccgcctcagcggcagccgcaaactcagtagccgcccgtgctgcccgtggctggggcgagggagcccagagctggggaccaaggctccgccacctgcggcacagcctcacacctgaacgctgtcctcccgcagacgagaccggcgggcactgcaaagctgggactcgtctttgaaggaaaaaaaatagcgagtaagaaatccagcaccattcttcactgacccatcccgctgcacctcttgtttcccaagtttttgaaagctggcaactctgacctcggtgtccaaaaatcgacagccactgagaccggctttgagaagccgaagatttggcagtttccagactgagcaggacaaggtgaaagcaggttggaggcgggtccaggacatctgagggctgaccctgggggctcgtgaggctgccaccgctgctgccgctacagacccagccttgcactccaaggctgcgcaccgccagccactatcatgtccactcccggggtcaattcgtccgcctccttgagccccgaccggctgaacagcccagtgaccatcccggcggtgatgttcatcttcggggtggtgggcaacctggtggccatcgtggtgctgtgcaagtcgcgcaaggagcagaaggagacgaccttctacacgctggtatgtgggctggctgtcaccgacctgttgggcactttgttggtgagcccggtgaccatcgccacgtacatgaagggccaatggcccgggggccagccgctgtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctccttcctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgccgcgcctcagcgactttcggcgccgccggagcttccgccgcatcgcgggcgccgagatccagatggtcatcttactcattgccacctccctggtggtgctcatctgctccatcccgctcgtgatatgcttttgtttactgtaggcaaactggaagtggagtcataaaacaactgatgggatgtcagatgagtgtgaagcacatctatacatacaagagaaatgccacaaatttgggtgcgagtattcgtcaaccagttatatcagccaagtttggagcgagaagtcagtaaaaatccagatttgcaggccatccgaattgcttctgtgaaccccatcctagacccctggatatatatcctcctgagaaagacagtgctcagtaaagcaatagagaagatcaaatgcctcttctgccgcattggcgggtcccgcagggagcgctccggacagcactgctcagacagtcaaaggacatcttctgccatgtcaggccactctcgctccttcatctcccgggagctgaaggagatcagcagtacatctcagaccctcctgccagacctctcactgccagacctcagtgaaaatggccttggaggcaggaatttgcttccaggtgtgcctggcatgggcctggcccaggaagacaccacctcactgaggactttgcgaatatcagagacctcagactcttcacagggtcaggactcagagagtgtcttactggtggatgaggctggtgggagcggcagggctgggcctgcccctaaggggagctccctgcaagtcacatttcccagtgaaacactgaacttatcagaaaaatgtatataataggcaaggaaagaaatacagtactgtttctggacccttataaaatcctgtgcaatagacacatacatgtcacatttagctgtgctcagaagggctatcatcatcctacaactcacattagagaacatcctggcttttgagcacttttcaaacaatcaagttgactcacgtgggtcctgaggcctgcagcacgtcggatgctaccccactatgacagaggattgtggtcacaacttgatggctgcgaagacctaccctccgtttttctactagataggaggatggtagaagtttggctgctgtcataacatccagagctttgtcgtattttggcacacagcagaggcccagatattagaaaggctctattccaataaactatgaggactgccttatggatgatttaagtgtctcactaaagcatgaaatgtgaatttttattgttgtacatacgatttaaggtatttaaagtattttcttctctgtgagaaggtttattgttaatacaaggtataataaaattatcgcaacccctctccttccagtataaccagctgaagttgcagatgttagatatttttcataaacaagttcgagtcaaagttgaaaattcatagtaagattgatatctataaaatagatataaatttttaagagaaagaatttagtattatcaaagggataaagaaaaaaatactatttaagatgtgaaaattacagtccaaaatactgttctttccaggctatgtataaaatacatagtgaaaattgtttagtgatattacatttatttatccagaaaactgtgatttcaggagaacctaacatgctggtgaatattttcaactttttccctcactaattggtacttttaaaaacataacataaattttttgaagtctttaataaataacccataattgaagtgtataatataaaaaattttaaaaatctaagcagcttattgtttctctgaaagtgtgtgtagttttactttcctaaggaattaccaagaatatcctttaaaatttaaaaggatggcaagttgcatcagaaagctttattttgagatgtaaaaagattcccaaacgtggttacattagccattcatgtatgtcagaagtgcagaattggggcacttaatggtcaccttgtaacagttttgtgtaactcccagtgatgctgtacacatatttgaagggtctttctcaaagaaatattaagcatgttttgttgctcagtgtttttgtgaattgcttggttgtaattaaattctgagcctgatattgatatggttttaagaagcagttgtaccaagtgaaattattttggagattataataaatatatacattcaatctgagttgcata

SEQ ID NO: 72729 - DNA, 222 bp, Homo sapiens
gggattacaggcgtgagccaccgtgcccagcccatgactggtttttctgaggcttattatgtagcttcctcttttcctggaacttgttaccagaaatgaaggcagcttcctaatattgataaggtagacatagcatttatatgttttcccaattgattaatgatgaaatctaaatgtgcgatctcacttatgcaggtgcgagtattcgtcaaccagttatat

SEQ ID NO: 72730 - DNA, 3422 bp, Homo sapiens
cgggagcggaccgtaagcccggcagcccgagaggaagatgaacagccccaggcagagcctctcggagagtggaccccgagccgcccccaggtagccaggagccgcctcagcggcagccgcaaactcagtagccgcccgtgctgcccgtggctggggcgagggagcccagagctggggaccaaggctccgccacctgcggcacagcctcacacctgaacgctgtcctcccgcagacgagaccggcgggcactgcaaagctgggactcgtctttgaaggaaaaaaaatagcgagtaagaaatccagcaccattcttcactgacccatcccgctgcacctcttgtttcccaagtttttgaaagctggcaactctgacctcggtgtccaaaaatcgacagccactgagaccggctttgagaagccgaagatttggcagtttccagactgagcaggacaaggtgaaagcaggttggaggcgggtccaggacatctgagggctgaccctgggggctcgtgaggctgccaccgctgctgccgctacagacccagccttgcactccaaggctgcgcaccgccagccactatcatgtccactcccggggtcaattcgtccgcctccttgagccccgaccggctgaacagcccagtgaccatcccggcggtgatgttcatcttcggggtggtgggcaacctggtggccatcgtggtgctgtgcaagtcgcgcaaggagcagaaggagacgaccttctacacgctggtatgtgggctggctgtcaccgacctgttgggcactttgttggtgagcccggtgaccatcgccacgtacatgaagggccaatggcccgggggccagccgctgtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctccttcctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgccgcgcctcagcgactttcggcgccgccggagcttccgccgcatcgcgggcgccgagatccagatggtcatcttactcattgccacctccctggtggtgctcatctgctccatcccgctcgtggtgcgagtattcgtcaaccagttatatcagccaagtttggagcgagaagtcagtaaaaatccagatttgcaggccatccgaattgcttctgtgaaccccatcctagacccctggatatatatcctcctgagaaagacagtgctcagtaaagcaatagagaagatcaaatgcctcttctgccgcattggcgggtcccgcagggagcgctccggacagcactgctcagacagtcaaaggacatcttctgccatgtcaggccactctcgctccttcatctcccgggagctgaaggagatcagcagtacatctcagaccctcctgccagacctctcactgccagacctcagtgaaaatggccttggaggcaggaatttgcttccaggtgtgcctggcatgggcctggcccaggaagacaccacctcactgaggactttgcgaatatcagagacctcagactcttcacagggtcaggactcagagagtgtcttactggtggatgaggctggtgggagcggcagggctgggcctgcccctaaggggagctccctgcaagtcacatttcccagtgaaacactgaacttatcagaaaaatgtatataataggcaaggaaagaaatacagtactgtttctggacccttataaaatcctgtgcaatagacacatacatgtcacatttagctgtgctcagaagggctatcatcatcctacaactcacattagagaacatcctggcttttgagcacttttcaaacaatcaagttgactcacgtgggtcctgaggcctgcagcacgtcggatgctaccccactatgacagaggattgtggtcacaacttgatggctgcgaagacctaccctccgtttttctactagataggaggatggtagaagtttggctgctgtcataacatccagagctttgtcgtattttggcacacagcagaggcccagatattagaaaggctctattccaataaactatgaggactgccttatggatgatttaagtgtctcactaaagcatgaaatgtgaatttttattgttgtacatacgatttaaggtatttaaagtattttcttctctgtgagaaggtttattgttaatacaaggtataataaaattatcgcaacccctctccttccagtataaccagctgaagttgcagatgttagatatttttcataaacaagttcgagtcaaagttgaaaattcatagtaagattgatatctataaaatagatataaatttttaagagaaagaatttagtattatcaaagggataaagaaaaaaatactatttaagatgtgaaaattacagtccaaaatactgttctttccaggctatgtataaaatacatagtgaaaattgtttagtgatattacatttatttatccagaaaactgtgatttcaggagaacctaacatgctggtgaatattttcaactttttccctcactaattggtacttttaaaaacataacataaattttttgaagtctttaataaataacccataattgaagtgtataatataaaaaattttaaaaatctaagcagcttattgtttctctgaaagtgtgtgtagttttactttcctaaggaattaccaagaatatcctttaaaatttaaaaggatggcaagttgcatcagaaagctttattttgagatgtaaaaagattcccaaacgtggttacattagccattcatgtatgtcagaagtgcagaattggggcacttaatggtcaccttgtaacagttttgtgtaactcccagtgatgctgtacacatatttgaagggtctttctcaaagaaatattaagcatgttttgttgctcagtgtttttgtgaattgcttggttgtaattaaattctgagcctgatattgatatggttttaagaagcagttgtaccaagtgaaattattttggagattataataaatatatacattcaatctgagttgcata

SEQ ID NO: 72731 - DNA, 518 bp, Homo sapiens
  misc_feature (89)..(89): n is a, c, g, or t
atagtcttccctgatgcgacgatctgtaaaaaaccacaacttggcagccacagaactacacatcttgatcagcttgtgcttccttgccnggattatttcctcttggatgtaacgtctacctgggtcggggggctcctccctcgctctcggccgactgagccgggctggggccgcttttaaattacttctctcctaatgatgacctgagtcctgctattcaatgggagagtcaataagatcctgtaggatcttatttggaactgactttgtcgattttaattttgttcctgcttgtttttaaattttcttgttgtttccctagaaaggaaagatgatgcttagttttaaatatttaaaaatgtgcaagttgctttgctataataaaactaaatgcatacatacaaaaaataaaattatagttgatgtggtagtgtttggaattcaaaatataaatgcttagcgtgaggtaatcctttatctttccacattttaccagtttgtaagtttgagtatttaat

SEQ ID NO: 72732 - DNA, 351 bp, Homo sapiens
agtataattgtgtttacttttggcctcatgagagaaaggaaaatatactattctattaaatacttcttggtagctgggtctcaattttcctgctcttaggtctgggcatacttttataaaagtcttgagtgtattttttttctattatggctccatgtcacccccattcattcattcagcaaatacttattgagcatctactatatgtcaggaacttttctagctcctggggagctagctcctgccttctgggaacttaggttctagagggtaaagacaaaaaagaggcaagaatgtatgtcagacagtgataagtgtcatggagaaaaataaagtagggcagtggagata

SEQ ID NO: 72733 - DNA, 278 bp, Homo sapiens
cacacacacacagccgccactcgtggtcctcccaggaggccttaggagtgtgtggagccccccaccgagcatattgatcaaagccaccctcggaggggagcctgttccctgggtgtgatgaaagagcaggctctggagttggcagccctggtttggagcgtgggcccaccatgctccagctgcgggaccccaggtgaggcagttccctgaggggccgtttcctcagctgtaagatatacacgacaatgccttctgccaggctgatccagagagccact

SEQ ID NO: 72734 - DNA, 1062 bp, Homo sapiens
acagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttata

SEQ ID NO: 72735 - DNA, 1173 bp, Homo sapiens
acagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaataggccacttgttttctacacattccctgctttttaagggagcacatattatgtgccaggcactgctgggaaagacagaataaactataaacctggtgttgaggctac

SEQ ID NO: 72736 - DNA, 910 bp, Homo sapiens
gggagagggagggagaataaagaaggagaagggaagaaaagggaaaggaagggtgggaaaagaaggggaagggaagagaggaagggaaagagcctgccataatgaatttgggaatctgtttcaagatgctacaacctagtgtaaaagaaaaactgttttcagtatagcctacacctcttagataaagttatgacttttcacaaaatttagcaggcaaaactacttactacctaaaggactgataaattttactactttcccttcctatacaagttcagaaaaatagaaatatttgtctaaacgacagaagtttcaaaaatttcagaatataaattctttattattttatccaaatttaagcatctgatgtgtgatatgagtatataacatatacctttacagtccaattagtaaacatattagtctattaaaatatgaagatttcagaagagctcttccaataaagaatttgtttatagtccaacagattataattcaatttcaattgataaattttcttgcgtgccagtatatatgatatgaacataaataaaacccttacaatttagtgagacagaaaaatatgtacacgttaaccaccaccaaccgtccgctctaggcagatctttcaacataaaagagtgctttctacattcttggagtctcaagtcagtttgttaaactgcgcttatatatattaacatgccaatgtttggttactgagtgtagcacttaaattttcaaaggagaaaaacccttctcaaactataaactacacatctaactcggattagcaagaaccaccattagtgagaaagcaaagcaggtggccaagaaagatgtaaccaattccccatcacttccagaggaataattcatagctggttaggcagacagagaagaattattc

SEQ ID NO: 72737 - DNA, 716 bp, Homo sapiens
  misc_feature (673)..(673): n is a, c, g, or t
gaataccctgttcttttctaccgtctttttaagttgataggtaagcagcattcaaggaaggtgggaataaaaattgttgaaatgtttaaatataaaatgatatacatatatgtaaaatttcattatccacattaatggagtggatacatcaaaatacattttttaattgtgtgtttcctaagaatgtggctttgtgatcatataaggattcacaacattaacaaatcttattttctgatatctaggatttttcttaactaaaaccatggaccagtcatctccatcctcctttcttgctctttgcccttgccctcccttctttgaaaaaaaaaatattttttagaagaattgcagaaatttctcacattggtcccaacaatggaaacacaatacaaagacacattcaaagaaaagtctatacaaccttagggtggaagtgatctttttaacaagattggaaacacagacatattttacttaataaaaaatttaaatgtcatatggcagggaccacagtcaaagttaaaacaacaagtagactagaagaaatatttgtatagtaataggaaacatgtcagtgtccctgtatacaaagagaagtttaagttataatgaagatgaacacactttatatttgttgactttttcaatgtcctgttctgtgaattgcttnttcacagtgtgaccacttctccaataacgtcgacgcggccgca

SEQ ID NO: 72738 - DNA, 343 bp, Homo sapiens
  misc_feature (300)..(300): n is a, c, g, or t
tttttatcagattggtttaaggttaaatagtgacaatatccattttggtgaagatgcaaggaaattggcagaaacattgctggcaaagttatctgggtgtgaattaaaatcaaatacacataactttcagtgaacaaccttctgagaaattatattgtcactatttaaccttaaaccaatctgataaaaactagtattacagtaatactttttaaaaaacaatccattaacccttataatgaagatgaacacactttatatttgttgactttttcaatgtcctgttctgtgaattgcttnttcacagtgtgaccacttctccaataacgtcgacgcggccgca

SEQ ID NO: 72739 - DNA, 708 bp, Homo sapiens
aaaatttaaatgtcatatggcagggaccacagtcaaagttaaaacaacaagtagactagaagaaatatttgtatagtaataggaaacatgtcagtgtccctgtatacaaagagaagtttaagttattggagaagtggtcacactgtgaataagcaattcacagaacaggacattgaaaaagtcaacaaatataaagtgtgttcatcttcattataagggttaatggattgttttttaaaaagtattactgtaatactagtttttatcagattggtttaaggttaaatagtgacaatatccattttggtgaagatgcaaggaaattggcagaaacattgctggcaaagttatctgggtgtgaattaaaatcaaatacacataactttcagtgaacaaccttctgagaaattataaaaataaaagcttccatgcataaaaatgtaaggacacagatgtttattgaaacatattctagaggccagatgtgttggctcacacctgtaatctcagcactttaggaggctgaagcaagcacaggtcacttgaggtcaggagtttgtggccagcctggccaacatggtgaaacccatctctactaaaaatacaaaaattagtggagtatggggttgtgtgcctgtagtcccagctactcaggaggctgaggcaggagaaccacttgaacccaggaggtggaggttgcagtgagcc

SEQ ID NO: 72740 - DNA, 755 bp, Homo sapiens
gtgatgagatctcattgtgttctccatgctgatttcaaactcctgggctcaaacaatcctcccattttagcatcccaaagggatgagattacaggtatgtaccaccataactttacaaaatgagatttttatataagaatgattcaaatgttcagggatgaaagagtcactaacataaaagaagaatgggatgaggtgagaaggatgaatacaaaaataattagatattcttgaaatcagaaatgtgctccctaattatatgaaatgttgtttgattacataaaataaagtggaaatgaatgattgactgaacagcccacaagaagaatcacttaatgctctgaaaattaccagtaaactgattaaaatctaaaattgctttctgttaaagctttactgattagtttttcttccaaagctctcttgtttctagttgttttcttggtcttaactacccattatatgctttgttaaagtgtttatgccctgattcaatgtgattatctcaatttttatttcattctgtcctaactcttgcaacctgcatgtcctctttattattgatcaatccaactgcaaagttcaccttacctgactaaggattattcattaagttttacttgtttatctgacatttattattttgtctctttgctagtcactctgagccatggtcatgatgacttaggattctggatctcttatgaataacaaatttatccttaataaagtctctatactaaagaagaatctaa

SEQ ID NO: 72741 - DNA, 854 bp, Homo sapiens
ttggagcctccgtgcccacaggctcctgtctcctcagcatggggcccgcccccttgggggtatgctctccacaggtggctggggacagggaggtgagcccacctagagctgccaacagagaccctccccacccccaccccaatgggggaaagggaaggaggggttggggaaaccgggcatagagttcagctttgttgcccctggctgcaaggccttgtgttggctgagtttcgctctctagccctcagttccctattgtataaaaggcaacattggcacctgcatgctctctttctcaggatcagataagaatatactaaaaagtggatcagaatgtgctgagtctggggtcagcgatacgtggcatcactgtgcttacccaggaggcctgagacgcctctccatcagagcccaatgctacccagcgctcctctccccttttcccattccttggtcaacattagttggtggcctggcaccaatgtccaagaggtggtgtgacataaaagaggcacctcctggggagtcagatgacctggattccagccctgaccatgccaggctaaccacatggccttgagcctgccactcgaccttgctggaacagtttcctcctgtgctacgtgaggatgctactgcttgtttgagagacaaagaagatcaaggtggttaagcaccccccagccccaaaagacttggacaaattgcaaaacccataaaagtgtaagtacactactggccgggtacagtagctcacacctgtaatcctagcactttgagaggctaagccaggaggattgcttgaggccaggagtttgagatcagcctgggcaacatagcaagaccctgtttct

SEQ ID NO: 72742 - DNA, 481 bp, Homo sapiens
cacctgcacggtaggccttccatatgacaagactggtaccactaatcctctttgtttctatgacgtttttcaccttcacggtaggccttccatatgacaagactggtaccactaatcctctttaattttctggatattgtgggctttttaaaccaatctcattagtggcatctttacatggagagattgagagaaagggcacttcccctttaaagaaatcagtctttttggttgatcttggccactgttctgaggaatcgttatagccgctaggggaaaacttaatcttcatccactgaccagaacaagctataatccatgtgtgcccaaacttggaagttcacaaagccattaaagggctttaaaagcacagttgttagcaccttggttgcttagtggtggctggagttactctggccctttccgttctcccaaagccttcccagaaaagtatggaacttaggtgtggaacagaaatgac

SEQ ID NO: 72743 - DNA, 1067 bp, Homo sapiens
gttattaatgttaaagaaccacagaatgttgtaaatatagattcatatacaatttctcattaaagtcgattgtatgcctatcagcaaaacaatatttacatgggttttgattaggatggaagaatgctctcattctatttaaatagacagtataaaagtacaatatttgctaaaattgaattgttgctgggaatttttgctgggagaaaagataaaggactcttgaggactaattatatggaaggtagcagaaggtggtcctacagaacagcagattgaggactaaatatacaaaaaatgctggctactcagctaagctcttattactgagtagaggcaggaagatactgttcaggtgagagaaaaactgaaactaacaaaaacatccctaacccagagagagtttctctctctctttgtcattcttgtcttgtttcttgtttgcagatccacagttgagacaatgtgctgctctgtatgtcaaggtcagactttggctgtttgtttctgatgtctccactcttaggagacaggacaccagcttccaggtttctctgaggtgctttgaaatgtgtagaaagatagtctccagttagattacttattaggcaactctgagataccatgacctttgttaaataacaagaacaccacctccttgctctcctgcttctgccctcagtgggagaaactggcaggagcctcatcagcacatatcaggggccctaagagttcagtcaaagatctaatgagtcacaggatgggggatgaaattgggaaaggtctggattagcagagttgctgcagaaagaagtagaggggaatatcttagaaggcacttggacagaatgggggtgatataaaagatgtatgctgtcatttttgttttggctcctagaaaatatagcagaaagtgagaatttgtgccatacatcctgttctgcaccttaatatggaagtttgcctttccacacgagtcttccttcacaattaacctctaattttttttttgcagttttctccagattttggaagattacgacaaacttcctaaaagattagaaaaa

SEQ ID NO: 72744 - DNA, 388 bp, Homo sapiens
tgcagactactgagccagttaggtggcaagcctcagctagggagggcactgggtctggaacaggtcgtgtacgttcaaagtcgtgactgcgggcagcttgcctcattcctctgtgcttcagttctgtgctctgtaacatggggataattatagtgtacagctcataaaatggagaggattaaatgaaataacataaagcacttagacacatagtgtcttagacatattgagcccatagtggcactcaataagattacttgctcttgatgttattatgtttgtcactgtcccgcttattccaaaaccagtcagctcttccctcctgaggggccacagtagcagcagcactgaggcatgcaccatattgaatgtgaagttgaatgatttg

SEQ ID NO: 72745 - DNA, 1743 bp, Homo sapiens
ggcagacagacagaagcacacatatgattaatacagcacagctgcaagacagttatatgctgcccagctagctgcaatgcaggtatctccaggagggaagctgccaggcataccccaaggcaaccttggtgctgctgtatctcctaccagcattcacacagacaagagcacaaacagcccaccacccaaaagcaaggatgaagtggcacagccactgaacctatcagctaaacccaagacctctgatggcaaatcacccacatcacccacctctccccatatgccagctctgagaataaacagtggggcaggccccctcaaagcctctgtcccagcagcgttagctagtccttcagccagagttagcacaataggttacttaaatgaccatgatgctgtcaccaaggcaatccaagaagctcggcaaatgaaggagcaactccgacgggaacaacaggtgcttgatgggaaggtggctgttgtgaatagtctgggtctcaataactgccgaacagaaaaggaaaaaacaacactggagagtctgactcagcaactggcagttaaacagaatcaagaaggaaaatttagccatgcaatgatggatttcaatctgagtggagattctgatggaagtgctggagtctcagagtcaagaatttatagggaatcccgagggcgtggtagcaatgaaccccacataaagcgtccaatgaatgccttcatggtgtgggctaaagatgaacggagaaagatccttcaagcctttcctgacatgcacaactccaacatcagcaagatattgggatctcgctggaaagctatgacaaacctagagaaacagccatattatgaggagcaagcccgtctcagcaagcagcacctggagaagtaccctgactataagtacaagcccaggccaaagcgcacctgcctggtggatggcaaaaagctgcgcattggtgaatacaaggcaatcatgcgcaacaggcggcaggaaatgcggcagtacttcaatgttgggcaacaagcacagatccccattgccactgctggtgttgtgtaccctggagccatcgccatggctgggatgccctcccctcacctgccctcggagcactcaagcgtgtctagcagcccagagcctgggatgcctgttatccagagcacttacggtgtgaaaggagaggagccacatatcaaagaagagatacaggccgaggacatcaatggagaaatttatgatgagtacgacgaggaagaggatgatccagatgtagattatgggagtgacagtgaaaaccatattgcaggacaagccaactgataagggtcaaaagattgttgtgaccttaggacttaaagaagccctaactggttcatccttaccagtggccaagcacattaactttctcatacactgactgttactttaactgttagtcttaaatagttgggacatcagctgactaatagacctcagcctcaaaaggcttggaaagaaaaaacaaatacaacaagcaaacaacaatatcaacaacaagagattgaaataagctatgggtaaaataatgccagtaattcagctgctacatccaagcactgaagtcttacccgtcaacttttttttttttttaaataaactttatggctgtttgttctacaatgttctagaaattctcactcaggtacacagtgccaacaagtggcttgtgaatgtgttttgttgttttgtgctacaatttt

SEQ ID NO: 72746 - DNA, 1382 bp, Homo sapiens
ctacatgatatatgttgggaacttttgtagtaaaaaacatctcccacataaaaatattcaataactagataattagtctcagattcaaaatgcatgataacatatcatgtaacttttctgttcacatgtgaattatatcatgatctaatgtagaaatgagaaatgtatccattaaattatctatgagctttaagggacataatacaaaagtttggctagaatgcaaaccagaaaaaaaaaaatactgcccagtgtttatatctttaggtacaaaaccaccaccacctctgttcttgtgggatctcactaatcaaaaacaggtttatgtatttctgggttttggctaacatctcaactttagattttcttgttctcagccatatcactttctggaatgcttagaagctgtgcaaattggaatcctaacctcctttcttcataggatctcgctggaaagctatgacaaacctagagaaacagccatattatgaggagcaagcccgtctcagcaagcagcacctggagaagtaccctgactataagtacaagcccaggccaaagcgcacctgcctggtggatggcaaaaagctgcgcattggtgaatacaaggcaatcatgcgcaacaggcggcaggaaatgcggcagtacttcaatgttgggcaacaagcacagatccccattgccactgctggtgttgtgtaccctggagccatcgccatggctgggatgccctcccctcacctgccctcggagcactcaagcgtgtctagcagcccagagcctgggatgcctgttatccagagcacttacggtgtgaaaggagaggagccacatatcaaagaagagatacaggccgaggacatcaatggagaaatttatgatgagtacgacgaggaagaggatgatccagatgtagattatgggagtgacagtgaaaaccatattgcaggacaagccaactgataagggtcaaaagattgttgtgaccttaggacttaaagaagccctaactggttcatccttaccagtggccaagcacattaactttctcatacactgactgttactttaactgttagtcttaaatagttgggacatcagctgactaatagacctcagcctcaaaaggcttggaaagaaaaaacaaatacaacaagcaaacaacaatatcaacaacaagagattgaaataagctatgggtaaaataatgccagtaattcagctgctacatccaagcactgaagtcttacccgtcaacttttttttttttttaaataaactttatggctgtttgttctacaatgttctagaaattctcactcaggtacacagtgccaacaagtggcttgtgaatgtgttttgttgttttgtgctacaatttt

SEQ ID NO: 72747 - DNA, 433 bp, Homo sapiens
taatagactgaaaaataggaatgcaaggaaaagagctgacaaaagttttaacgctaacacgaagtgatgtttcctgttttcaggaagtgctggagtctcagagtcaagaatttatagggaatcccgagggcgtggtagcaatgaaccccacataaagcgtccaatgaatgccttcatggtgtgggctaaagatgaacggagaaagatccttcaagcctttcctgacatgcacaactccaacatcagcaagatattgggtaagaaaaccattaagaactaagtgacgtatggaataaaggtactgttctgttttctgcagttgtggaaggatcctggatttggaggccatacaggtcgtgttatttgcttatccagaaaataaacatcatcattgaggcttcttctggtgatgaagcattctatgtccattgag

SEQ ID NO: 72748 - DNA, 1502 bp, Homo sapiens
ggcagacagacagaagcacacatatgattaatacagcacagctgcaagacagttatatgctgcccagctagctgcaatgcaggtatctccaggagggaagctgccaggcataccccaaggcaaccttggtgctgctgtatctcctaccagcattcacacagacaagagcacaaacagcccaccacccaaaagcaaggttacttaaatgaccatgatgctgtcaccaaggcaatccaagaagctcggcaaatgaaggagcaactccgacgggaacaacaggaaaaaacaacactggagagtctgactcagcaactggcagttaaacagaatcaagaaggaaaatttagccatgcaatgatggatttcaatctgagtggagattctgatggaagtgctggagtctcagagtcaagaatttatagggaatcccgagggcgtggtagcaatgaaccccacataaagcgtccaatgaatgccttcatggtgtgggctaaagatgaacggagaaagatccttcaagcctttcctgacatgcacaactccaacatcagcaagatattgggatctcgctggaaagctatgacaaacctagagaaacagccatattatgaggagcaagcccgtctcagcaagcagcacctggagaagtaccctgactataagtacaagcccaggccaaagcgcacctgcctggtggatggcaaaaagctgcgcattggtgaatacaaggcaatcatgcgcaacaggcggcaggaaatgcggcagtacttcaatgttgggcaacaagcacagatccccattgccactgctggtgttgtgtaccctggagccatcgccatggctgggatgccctcccctcacctgccctcggagcactcaagcgtgtctagcagcccagagcctgggatgcctgttatccagagcacttacggtgtgaaaggagaggagccacatatcaaagaagagatacaggccgaggacatcaatggagaaatttatgatgagtacgacgaggaagaggatgatccagatgtagattatgggagtgacagtgaaaaccatattgcaggacaagccaactgataagggtcaaaagattgttgtgaccttaggacttaaagaagccctaactggttcatccttaccagtggccaagcacattaactttctcatacactgactgttactttaactgttagtcttaaatagttgggacatcagctgactaatagacctcagcctcaaaaggcttggaaagaaaaaacaaatacaacaagcaaacaacaatatcaacaacaagagattgaaataagctatgggtaaaataatgccagtaattcagctgctacatccaagcactgaagtcttacccgtcaacttttttttttttttaaataaactttatggctgtttgttctacaatgttctagaaattctcactcaggtacacagtgccaacaagtggcttgtgaatgtgttttgttgttttgtgctacaatttt

SEQ ID NO: 72749 - DNA, 552 bp, Homo sapiens
atgctttccacgttagttccagtgaatgcctgggatgagagctgtagcctagccttacaggccctctaaagccttggctgaagcagtgatgctggctcctcccaggacctgctggaatgttcctccttgtgttctgttctacttttcaccatccctactagcagtatttcctcgtcttccaaaatagcagggtctgattcctggtaatggtgctgagaccaggcgtgctgggttctctgagcagagtgtgtcgaggctattgccttttgctatacaggttctgtacattgggcctccaggttaattgggtttctagaaggatcctaggaagatgacatgtctttttcctttttgtcacatgctgacagagctggcctccctttcaactgggtttgaggtatttcctcagaggagagtgagctctgagttgtagaagtgtctgggtgtgattcaatccaagcaacaatcctgaggtactgcagggccgaacaccatctttctgggactgggtcctcaggacaagcaaggagttgatggaccaaaccctggttt

SEQ ID NO: 72750 - DNA, 308 bp, Homo sapiens
tgccatcccgcgccccgtttattgcgggcccgaaaaagatttcggccgcatctaggttaattgggtttctagaaggatcctaggaagatgacatgtctttttcctttttgtcacatgctgacagagctggcctccctttcaactgggtttgaggtatttcctcagaggagagtgagctctgagttgtagaagtgtctgggtgtgattcaatccaagcaacaatcctgaggtactgcagggccgaacaccatctttctgggactgggtcctcaggacaagcaaggagttgatggaccaaaccctggttt

SEQ ID NO: 72751 - DNA, 376 bp, Homo sapiens
ataaaagtctacacattgggtacagtgcacattgcttgggtggtgggtgtaccagagtctcagaaatcaccactgaagaatttattcatgtaaccaagcgccacctgttttctcttatatgaagaccaagctcagtaatgctgtgtttttatggacctataattgtgtccatgctgccctgtcattttaccagttcttgtatttgagcagataataccaaaaatggtgcaaacttacttttgctacagatgatgacaattttagactaggttacacatatttatacatatagtacctaagggtaggagctcaggcaagagtgtagggaggagcccagtaaatgtgagatgaaattctagagcaggtaaagtcaacg

SEQ ID NO: 72752 - DNA, 376 bp, Homo sapiens
ctactactactactaaaggcgcgagcggtcgaacaagatcgtaccattgcactccagcctgggcaacaggagttaaactctgtcttaataataataataataataaaattatctgggtgtggtggcgcatacctgtggtctaagctgttctggaggctgatttgggaagatgcttgagtgtgggaggtttaggctgcagtgagctgtgatcatgccactggagtctagcctgggcaacacagtgagaccccatctaaaaacaaaaacaaaaacaaaaacaaaaatatcatcagccagtcttgttggctcacgtttgtaagtaatcccagcacttttgggagactgaaggtgagatcacttgaggccaggagtttga

SEQ ID NO: 72753 - DNA, 402 bp, Homo sapiens
gcttccccagcacattatacaagcacaacaggaagctgcaattttgaaacaagttcaggaaactggaccacagcctgcagtcttactcaagactctgaggatgacttggactgggccattggcagcagaattcctgccaaagcattaattccagactctgatcacacgccaggtagtggtcagcacttcctgtacgtcaactcatctggctccaaggaaggatccgttgccagaattactacttccaaatccttcccagcaagccttggaatgtgtactgttcggttctggttctacatgattgatcccaggagtatgggaatattaaaggtgtataccattgaagaatcggggctaaacatcctggtgtggtcagtgattggaaataaaagaacgggatgg

SEQ ID NO: 72754 - DNA, 661 bp, Homo sapiens
gaatagctctgctctttgtactctggaacctcaaatgacactgaaactgcaatagtctgatttcctctggctatgaagttaggctgaggagagcacagcgggccctgctgacctcttgccaagtttctggttgttttcttttccaacaaggctgggtcctttctgcatcagaggaacgacactgtgtgctcagcactctctcagcacaactcagatggtgccctgcatctcccattgccctggaaaccacgctgaagagaagtgtccggatgccacctagtggagttagctattctctgttggtgccatctgttaataaaccaaactgggcttaatgaatcatcttcagcatcctcatagcactgctccttccacaacttgtcctcacctcctcatcactcttaatattatgactaattcttttagtggttgtagggtggctccaggtggggggcattcatgctgtggttctcagtccgggcaacaccttagaaccacctgggaggctttaaaaagtactggtatctgtgcccatttcaggccgtgaaacacaatctcctgggatggggctgggacattggtggttttgctgttgttgctttaacagctctattgaggtataattaacatttgataaagtgcacatttttaaaatgttcta

SEQ ID NO: 72755 - DNA, 378 bp, Homo sapiens
tgtttactatccattccagcaatattcctttatgccagcctccatcatagagattagagccaaagtgcctcattcttcacttccgtcacagctggggtggccgtggaactccgtcctggtcaatgtgttctaagtaggaatctgcttttgctcttttccccttcctccttctcccggtctggatcacaaggaattctggcagatgctgtatcactaagacaccgttaaaccgtggtaccagtcctggatgatctgtcactgtacctctagttatatgagactaacgaattcccctctgtttggtttacacactgtaactgagtttctatgtaatccaaattgaggccagaattagctgtttttcaggcattattctaa

SEQ ID NO: 72756 - DNA, 153 bp, Homo sapiens
gaaactgggtatcctgctataatgcgagttctgaaaatcaataggtcacaccacaacaaaggaaaatttgactacttagaccaatatgaggtcccttcagggagtgtctgtatactccctgaactctgcaggtaagtgtactccttaccttta

SEQ ID NO: 72757 - DNA, 497 bp, Homo sapiens
aagtatttttcccattgcccatgcagggaaattatataaattttatgtctgcaccaaaggtattatgtttaaagagataacagtttctgttctgggagaaaaatctgaggaaacacaatcaattttttgtttcccaccaagcaggtaaaagtagcttccttatacctggccacgtgagccactcagaaaaccccaaggggctccattcttttccttgaaggaaacggtgtttgtgagtttcaggagcctcatgcaaccggcacgttcctccacattgtcctttggtgacttgaggttgagaaggaacaatatttctcttcctaacttcaataagaggctcagagtcccagagagtttagttaacttccttgaggtcatgtgttaaataaggaaggaaggagacaaaacagctttctgggcacctgattccccctcttgcccacaggactctgctgttgttttcattctgtgggcagaaaatgcttaaaaaaaaaaaa

SEQ ID NO: 72758 - DNA, 548 bp, Homo sapiens
gagacggagtttcgctcttgttgctcttgttaatttaagatgtgtatctcaaatctctgcccttgtgactggcatatgttaattagctgggcatggtggctggcgcctgtaatcccagctactagggaggttgaggcaggagaattgcttgaacccaggaggcagaggttgcagtgagccaagatcgagccattgcactccagcatgggcaacaagagcaaaactctatctcaaaaaaaaaaaaaaaaaaattctcagattttcttgacaattgaatataatctataaacagaactgtttttattcttactcatcctttattcttctagtaagaattgcctagtaaggttttgaagtttttctcatatagttcacatatatttctagctaaaattattttcttcctattgtgaagacttttttaaaaataaaagtatgtgctaacttgttgaggacggcaatcaatctattagcttatatatttccttttcagtcactttactacaaattattgatagtaattgaatctcttctcattttggggactt

SEQ ID NO: 72759 - DNA, 478 bp, Homo sapiens
gtagcaatcatttaaacaaattccatttcatagatttgaattgagaagggcttagaggactctctgaatgacctccatgctttcatcctggcattgctgttttctcagggagcaaacttttccagagcctcttcctcagacttctaacaattctaagttccacttaggacctgccgtacattgagtgtttatttcctccccaaattcatatgttgaaatcctaacaccgaatatgaggagtgtttgcagctggggcttttgagaggtgatgaggtcacaggggcagagccctcattaataggattagtgtccttatgaaagagaccccagagagcttcctcacttctcctgctatgtgaggatacagtgagaagatgaccatctgtgagccaggaacgggccctcagtggaactcaatctacttgtacttcccagcctctagatctgtgagcaataaatttcctttgttttaaagcca

SEQ ID NO: 72760 - DNA, 300 bp, Homo sapiens
gggttgattctctatctgagtgagtggtgcatctgcatctctgggttctattttatgtggggttgattctctatctgagtgagtggggtgtctgcatctctggatcctgttgtatatggggttgattctctatcggagtgagtggggcatctgcatctctgggttctgttgtatgtgggagtgatgctccatctgagctgggcgtctgcatctctgggtttatggatccctaagcccaactcactcacagcttggccctccatgtgctggtctttcctctgccttacccatgtttggtta

SEQ ID NO: 72761 - DNA, 573 bp, Homo sapiens
gaaaatgttaaaaacatacttttaaaagaaatattttgctaatacaaacaagtggaaaaatagtcaacaggctttacagtaggtactataggaggtagggagagagatcaatcaaccaattaatagacagatgaagggtatagcctgctgaacctgttatttgagagactatttagcctaattaccagcatgtcaaagaaaagatgacactcacaactttgtccaaatctgaggcaagactcactcacagaagcagtagagacatatttctttatgtatctttgcttcagtcacctggcgctggggacagaagtaccgtgaagagatgaacgttgcagaacaatgtctcaggtattcaggcatgcaatactttccacagatgtcagaaatggcaacttgctgcagggagacacaaggtcattccatgcaccattatcaggattgtggtgcacagactgtgagcagactacttaatgcatctctgattcagccagccattcttcttgtcttccaaatgctttgtattaagtcattgttgagctctataaagtcctttgaaaacacaaaaaccat

SEQ ID NO: 72762 - DNA, 395 bp, Homo sapiens
agattgagattccagagcatcggatgaacgggacttatagctaaggcgtactcacccacccctcccttcgtctttttacgcacgcagcaactcgtcctcacgtgcataggggtagtggacagtgttgacttgaattgctgtccctcgttccaagcctttcctgtgaatgaacccgaaaacactcgacaggtcgtgaataatcgttttaatgagtgtgcaaagcgtgcgacggggtgcaccgagctgtcgggttaaacaaacaacttgtaccctgaccaaatccgattgttaaagtgcaaagtgatgtcagtaccatttccattgcctttcggaaatccacagatctgacacgcgggagtccaattttccccattaaagaaaaataacaataaatt

SEQ ID NO: 72763 - DNA, 393 bp, Homo sapiens
tgagatggtgtctcactctgtcgcccaggctggagcgcagtggcatgatctcggctcactgcaagctccacctcctgggttcacgccattctcctgcctcagcctcccaagtagctgggactacaggcacccgctaccacacccagctaattttttgtatttttagtaaagacagtgtttcaccatgttagccaggatggtctcgatatcctgaccttgtgatccgcctgcctcggcctcccaaagtgctgagattacaggcgtgatgggattacaggtgtaagccattgcacccggccacagtcatacttatccttattggttattcttactggttattctcaatcacaccctctcgaccagtactggccaacagaactctatgcacagatg

SEQ ID NO: 72764 - DNA, 399 bp, Homo sapiens
ccaagatgaatgtggtttatacaattcctcctttgttctccagggtctgggcagaccaaatgttctccagaaggcatctcagcaggtgtccttggatgtgtgtgctttatttaggcttcctcaagctatagaacttaatggacagcctagctagaaaatgcagcagccaaaaaagaaaattcaagaacagtgagtgttgttcaactccattagagggaaactcattcgccatcatgtatcctcagttcacactgtgtttttgatcccaggataaaagacagtcagaggcaatataactcagtgattaagcactcaggccagagtcaagtgtaccagccttttagtcctggtgctgtcacaaactggctgaatgcccctgggcatggtccttggcgttgg

SEQ ID NO: 72765 - DNA, 341 bp, Homo sapiens
ttggagtcaggtgcttccaggtctcccagactggtactgcatactggtggctctacagttatggagactcgaggtggccccatccttatggctttgataggcattgagctagtggaggctgtctgcagggcttaaacctgtggtagtactctgcctgggccccagggctctccaatgcatcctttaatatcttggtggaggtagctgtgcctccacagctcttgcactctgagtacctgcagagttggcaccctgtggacgccaacaaggtttactgcttatactttcaaagagacagcccaagctgtacctgtgctggcttgtgccacagctagggtggc

SEQ ID NO: 72766 - DNA, 734 bp, Homo sapiens
tttcaagtcagtatttctttttttcaaattagctgcagttcttttaagccttaaagaaatctttgatatatgcaacactgccctgagctgaacggtggggttggagttggctagccggggaaggctataggacagagaaaaaagggggggtgagtgggggaaggccataggacagagaaacatggggagcaaattaccaaactgtacctccctggaaaatgctcattctactttttaaaaaagtttgttaccgtaagtagtgtctatgtattggcaactgttctgctgattcgatgaatgtaataaatcataccttcttaccttcttgtaaaatcacctgcattgggactaaaggccatagtcccctaagaggggaaaggcttttctctaagaaagaagttaggagttcttgaaaggattgatgatccacttcctcagtaaaaaatgtattgaggaggccaggcacggtggctcatgcctgtaatcccagcactttgggaggccgagggatcacctgaggacaggagcttgagaccagccttgccaacatggcaaagccccgtctctactaaaaatacaaaaattagccaggtgtgctggcaggcacctgtaaccccagctactcgggaggctgaggcaggagaatcacttgaacctgggaggtggaggttgcagtgagccaaaactgcaccactgcactccagcctgggtgacagagcaagactctgtctcga

SEQ ID NO: 72767 - DNA, 560 bp, Homo sapiens
tatatcattagcaccatatcccatggtcagccccacctgaataaacggcatattgggatttttccacaaactatgagcctaatgaaaaaggaaatggataagggaaacaagttcccagcctatgtcacatgagtttctgcactacgtgttatgtggtaaggtatgcattccctcaggacttcccaaatccattacatgctagggttttctctctggtatgcattctggtgtgatgtaccctaagagctgccttacggacaaaagttttcccacattcatcacattcatagggtttctcccctgtgtgaattctctggtgtactctgagagttgaattttgggcaaaagctttcccgcattcattacactcatagggtttctcccctgtgtgaattctctggtgtgcactaaggtgtgatttctgggagaacgttttcccacaatcattacattcataggatttctcccctgtgtgaattctttgatgtactctgagggttgaattatgggcaaatggcttcccacatacattacattcatagggtttctcccccgtatga

SEQ ID NO: 72768 - DNA, 341 bp, Homo sapiens
gagaaaaaagaaaaaaatagaaaaatgtaacaacatattgtttagggatacatgcacgtatgatgaactgtttttgaaaacaaaaaattaagggaacaataagcgaaatctgggatagtggttacctctaagggagcagcaagcagatggaataaagcacatagtagctgcactggtattaatgctaattctcagttaatgtggtaagtgacaggatgtatttttttatgcttcataattacgtgtacacattgcacatatcaaatacagaatagcattttaaaagataagttaaaacagacttcaataagaaaattagcctatgtgcaaaatttaactgt

SEQ ID NO: 72769 - DNA, 510 bp, Homo sapiens
cctgctctttattattcatagaatttatatgcaagtccggacagtggctgtggaaggatatgtccaagctgtggctgggcgtctggagggcagtgccatgcaactgtaagggctttggtagcattgcatggctatgcataaattcagcagttaaatataacacccttacacccccaccctgaaccattgaactcctgacctcaagtgatctgcctgcctcggtatcccaaagtgttcagattacaggcatgagctaccgtgcccagccagaactttctacaatgatggaaatgttctgtatttgctctccggtacagtagccactagtcacatgtggctattgaaaactttaaatgtgactagtgcaattaaggagcttaattttttttaatttaattttaggccaggcctgtaatcccagcactctgggaggccgaggcaggcggatcacttgaggtcaggagtttgagactagcctggccaatgtggcagaaccccatctctactaaa

SEQ ID NO: 72770 - DNA, 554 bp, Homo sapiens
acttgattaggaaaagttagacaatcatagcaaaaacaaaaccaaaaaactttccttcttagaccaggtaacatgaggaagggggaaaaaaacccaaacaaaatagtccccccacatgacaggtgtcttcagcttgccatattgatccaaagttcatacattttatcatgtacaagatacattagacttacaataaagtctaattattagacttttatgtcagtggattgtgcttgcagaaatacagaagtaacatactgaccctaggtgaggagtttcttacatggttaactggattgacccaattggagtaaaagatttttgctgttacctcgatgctcctgcagttgttacctcagcatgccactgtagtccttgactctcacattaaaactaactttggctaggtactggtggctcacacctgtaagtaatcccagtactttaggaggctgagagtggaggattacttgagtccaggagttggagaccagcctggccaatatagactgtccctacaaagaaaataaaattgtttcatcttccaaaaaaaa

SEQ ID NO: 72771 - DNA, 2430 bp, Homo sapiens
tattcttttatatatagacataggtataatacatttcatataactgagaatttatacaaagcgtattctgagtttactcactttctccacaatgtttccttttctccttgcaataggaaaaaaaaaaagaagatgggttttttaagtccaatatatgttattttcttcttttttggagtcaaagtacattgccaatatgaaacttatcagtgggatgaagactatgaccaagagccagatgatgattaccaaacaggattcccatttcgtcaaaatgtagactacggagttccttttcatcagtatactttaggctgtgtcagtgaatgcttctgtccaactaactttccatcatcaatgtactgtgataatcgcaaactcaagactatcccaaatattccgatgcacattcagcaactctaccttcagttcaatgaaattgaggctgtgactgcaaattcattcatcaatgcaactcatcttaaagaaattaacctcagccacaacaaaattaaatctcaaaagattgattatggtgtgtttgctaagcttccaaatctactacaacttcatctagagcataataatttagaagaatttccatttcctcttcctaaatctctggaaagactccttcttggttacaatgaaatctccaaactgcagacaaatgctatggatgggctagtaaacttgaccatgcttgatctctgttataattatcttcatgattctctgctaaaagacaaaatctttgccaaaatggaaaaactaatgcagctcaacctctgcagtaacagattagaatcaatgcctcctggtttgccttcttcacttatgtatctgtctttagaaaataattcaatttcttctatacccgaaaaatacttcgacaaacttccaaaacttcatactctaagaatgtcacacaacaaactacaagacatcccatataatatttttaatcttcccaacattgtagaactcagtgttggacacaacaaattgaagcaagcattctatattccaagaaatttggaacacctatacctacaaaataatgaaatagaaaagatgaatcttacagtgatgtgtccttctattgacccactacattaccaccatttaacatacattcgtgtggaccaaaataaactaaaagaaccaataagctcatacatcttcttctgcttccctcatatacacactatttattatggtgaacaacgaagcactaatggtcaaacaatacaactaaagacacaagttttcaggagatttccagatgatgatgatgaaagtgaagatcacgatgatcctgacaatgctcatgagagcccagaacaagaaggagcagaagggcactttgaccttcattattatgaaaatcaagaatagcaagaaactatataggtatacacttacgacttcacaaaacctatacttaatatagtaaatctaagtaaacatgtattactcaaagtaatatatttagaattatgtattagtataagatcagaattgaatttaagttgttggtgacatctgcatcatttcataggattagaacttactcaaaataatgtaaatctttaaaaatataaattagaatgacaagtgggaatcataaattaaacgttaatggtttcttatgctctttttaaatatagaaatatcatgttaaagaaagtgagtgtatcatttctattaacagtaatttttctaaaaatgaggaaggaagtagcattagcagtaaagacccacaggccatgacctttttgatcactctgaggacaatatttaaatgacaggaaggtatattaatgtaacaagcattcatttaaggaatagaccattttctctgacctcttcttcaggaaagctttcacactggtatttgtgatctcaccattatgacatccatccccctagctcaccacatagcacatagaatgatatttttgatttgtaagaggccatccaggtactaaggacccaaggcatacagattcacaaaattaactaatctttttgcctcagaataccaaaacaacaaaattataaagctgtatttggacaactaaaaaacaccaaactatctcattgcaatttgtattttagcagatttcagcaactatcctaaacaatgttattgtgttccattttaactgggataaatgtttttgtaaaaatacaaccatagaaaggcctctttgttacaaaatgatttgcaaagaaataactgctttgtttgcaagattaaattagtgttggcaaaataaagttctaaagataatactaaacactttatgcttatcagccaatatctacataagctaaaattgaatacagttcctttataatttgaatgacaggttttaacatcttctttaaaaccttaaaaatcactttttcgttaatgtattattt

SEQ ID NO: 72772 - DNA, 2575 bp, Homo sapiens
tgaccaagaacacaagcatcttaatttgaatccacaaagtttcatgtaatgaaaagaaatacataattttaattcaacccgagtgttttccaagaagattgtatttgcttaaattgctacagtaattcaagagacagccctgtctggacacagagttactgtggatttttaagagactcagttaaagaatttaggaatttctgattcatttaaaggatttacaaattcatcaacccctgaaaactaaagcaaattgaacaggaaaaaaaaaaagaagatgggttttttaagtccaatatatgttattttcttcttttttggagtcaaagtacattgccaatatgaaacttatcagtgggatgaagactatgaccaagagccagatgatgattaccaaacaggattcccatttcgtcaaaatgtagactacggagttccttttcatcagtatactttaggctgtgtcagtgaatgcttctgtccaactaactttccatcatcaatgtactgtgataatcgcaaactcaagactatcccaaatattccgatgcacattcagcaactctaccttcagttcaatgaaattgaggctgtgactgcaaattcattcatcaatgcaactcatcttaaagaaattaacctcagccacaacaaaattaaatctcaaaagattgattatggtgtgtttgctaagcttccaaatctactacaacttcatctagagcataataatttagaagaatttccatttcctcttcctaaatctctggaaagactccttcttggttacaatgaaatctccaaactgcagacaaatgctatggatgggctagtaaacttgaccatgcttgatctctgttataattatcttcatgattctctgctaaaagacaaaatctttgccaaaatggaaaaactaatgcagctcaacctctgcagtaacagattagaatcaatgcctcctggtttgccttcttcacttatgtatctgtctttagaaaataattcaatttcttctatacccgaaaaatacttcgacaaacttccaaaacttcatactctaagaatgtcacacaacaaactacaagacatcccatataatatttttaatcttcccaacattgtagaactcagtgttggacacaacaaattgaagcaagcattctatattccaagaaatttggaacacctatacctacaaaataatgaaatagaaaagatgaatcttacagtgatgtgtccttctattgacccactacattaccaccatttaacatacattcgtgtggaccaaaataaactaaaagaaccaataagctcatacatcttcttctgcttccctcatatacacactatttattatggtgaacaacgaagcactaatggtcaaacaatacaactaaagacacaagttttcaggagatttccagatgatgatgatgaaagtgaagatcacgatgatcctgacaatgctcatgagagcccagaacaagaaggagcagaagggcactttgaccttcattattatgaaaatcaagaatagcaagaaactatataggtatacacttacgacttcacaaaacctatacttaatatagtaaatctaagtaaacatgtattactcaaagtaatatatttagaattatgtattagtataagatcagaattgaatttaagttgttggtgacatctgcatcatttcataggattagaacttactcaaaataatgtaaatctttaaaaatataaattagaatgacaagtgggaatcataaattaaacgttaatggtttcttatgctctttttaaatatagaaatatcatgttaaagaaagtgagtgtatcatttctattaacagtaatttttctaaaaatgaggaaggaagtagcattagcagtaaagacccacaggccatgacctttttgatcactctgaggacaatatttaaatgacaggaaggtatattaatgtaacaagcattcatttaaggaatagaccattttctctgacctcttcttcaggaaagctttcacactggtatttgtgatctcaccattatgacatccatccccctagctcaccacatagcacatagaatgatatttttgatttgtaagaggccatccaggtactaaggacccaaggcatacagattcacaaaattaactaatctttttgcctcagaataccaaaacaacaaaattataaagctgtatttggacaactaaaaaacaccaaactatctcattgcaatttgtattttagcagatttcagcaactatcctaaacaatgttattgtgttccattttaactgggataaatgtttttgtaaaaatacaaccatagaaaggcctctttgttacaaaatgatttgcaaagaaataactgctttgtttgcaagattaaattagtgttggcaaaataaagttctaaagataatactaaacactttatgcttatcagccaatatctacataagctaaaattgaatacagttcctttataatttgaatgacaggttttaacatcttctttaaaaccttaaaaatcactttttcgttaatgtattattt

SEQ ID NO: 72773 - DNA, 2509 bp, Homo sapiens
  misc_feature (2420)..(2421): n is a, c, g, or t
  misc_feature (2463)..(2463): n is a, c, g, or t
tgaccaagaacacaagcatcttaatttgaatccacaaagtttcatgtaatgaaaagaaatacataattttaattcaacccgagtgttttccaagaagattgtatttgcttaaattgctacagtaattcaagagacagccctgtctggacacagagttactgtggatttttaagagactcagttaaagaatttaggaatttctgattcatttaaaggatttacaaattcatcaacccctgaaaactaaagcaaattgaacaggaaaaaaaaaaagaagatgggttttttaagtccaatatatgttattttcttcttttttggagtcaaagtacattgccaatatgaaacttatcagtgggatgaagactatgaccaagagccagatgatgattaccaaacaggattcccatttcgtcaaaatgtagactacggagttccttttcatcagtatactttaggctgtgtcagtgaatgcttctgtccaactaactttccatcatcaatgtactgtgataatcgcaaactcaagactatcccaaatattccgatgcacattcagcaactctaccttcagttcaatgaaattgaggctgtgactgcaaattcattcatcaatgcaactcatcttaaagaaattaacctcagccacaacaaaattaaatctcaaaagattgattatggtgtgtttgctaagcttccaaatctactacaacttcatctagagcataataatttagaagaatttccatttcctcttcctaaatctctggaaagactccttcttggttacaatgaaatctccaaactgcagacaaatgctatggatgggctagtaaacttgaccatgcttgatctctgttataattatcttcatgattctctgctaaaagacaaaatctttgccaaaatggaaaaactaatgcagctcaacctctgcagtaacagattagaatcaatgcctcctggtttgccttcttcacttatgtatctgtctttagaaaataattcaatttcttctatacccgaaaaatacttcgacaaacttccaaaacttcatactctaagaatgtcacacaacaaactacaagacatcccatataatatttttaatcttcccaacattgtagaactcagtgttggacacaacaaattgaagcaagcattctatattccaagaaatttggaacacctatacctacaaaataatgaaatagaaaagatgaatcttacagtgatgtgtccttctattgacccactacattaccaccatttaacatacattcgtgtggaccaaaataaactaaaagaaccaataagctcatacatcttcttctgcttccctcatatacacactatttattatggtgaacaacgaagcactaatggtcaaacaatacaactaaagacacaagttttcaggagatttccagatgatgatgatgaaagtgaagatcacgatgatcctgacaatgctcatgagagcccagaacaagaaggagcagaagggcactttgaccttcattattatgaaaatcaagaatagcaagaaactatataggtatacacttacgacttcacaaaacctatacttaatatagtaaatctaagtaaacatgtattactcaaagtaatatatttagaattatgtattagtataagatcagaattgaatttaagttgttggtgacatctgcatcatttcataggattagaacttactcaaaataatgtaaatctttaaaaatataaattagaatgacaagtgggaatcataaattaaacgttaatggtttcttatgctctttttaaatatagaaatatcatgttaaagaaagtgagtgtatcatttctattaacagtaatttttctaaaaatgaggaaggaagtagcattagcagtaaagacccacaggccatgacctttttgatcactctgaggacaatatttaaatgacaggaaggtatattaatgtaacaagcattcatttaaggaatagaccattttctctgacctcttcttcaggaaagctttcacactggtatttgtgatctcaccattatgacatccatccccctagctcaccacatagcacatagaatgatatttttgatttgtaagaggccatccaggtactaaggacccaaggcatacagattcacaaaattaactaatctttttgcctcagaataccaaaacaacaaaattataaagctgtatttggacaactaaaaaacaccaaactatctcattgcaatttgtattttagcagatttcagcaactatcctaaacaatgttattgtgttccattttaactgggataaatgtttttgtaaaaatacaaccatagaaaggcctctttgttacaaaatgatttgcaaagaaataactgcttttggttttgcaaggaatttaaaattanntggtttgggccaaaaattaaaagttccttaaaggattaattnccttaaaaccactttttatggccttaatcaggcccaaatattctta

SEQ ID NO: 72774 - DNA, 819 bp, Homo sapiens
ggtctccatctcctgacctcatgatgtgcccacttcggccttccaaagtggccgcaaagtggcccacttcggccaaagtgcacttcggccttccaaagtgcattacaggcgtgagccaccacgcccggcctggcctttttttttattattagtttttatgtgggagaacacagagtttcgcactacggatggcgccagggctgggagtggcaggggcgcaatcgtggggtatcactggacaacttgcgggccctcctataggctaacaaagcagagtcatcactgtgcgcgtcacgtcgctctccacaagataggtagggagattatcacggggcattgcatccaccctatgtgccagtggaaataaattatgatctcatatatgttagtgaggatagagacagagcaggagaattaacaactacagtgtgtggagccaagcgacgagagtatatggcagaaaaggtcgcgtggaccacaaaagtgggtgggataccaaggcgagaaactttgtggggcaccatcaagataatagtgagtgacatttgtggggataaaatatgtagaagataggattaattatacagagcgactcatgagagtcgccagtcttcgcgacaaagccaaacacccagtgaaacagagggggcaactaggcaagagctggatctccacatatacacattgtatacatcacagccccaaaagggggggcacgagacacacgcggtaaaagcggtgagtgattgggcaacaaccaaggagccgacccatgcgagggagagacgagagagaagcaacacacaccgccagggcccg

SEQ ID NO: 72775 - DNA, 1481 bp, Homo sapiens
ggtctccatctcctgacctcatgatgtgcccacttcggccttccaaagtggccgcaaagtggcccacttcggccaaagtgcacttcggccttccaaagtgcattacaggcgtgagccaccacgcccggcctggccttttttttttttttttttgagacacagtttcactcgttgcccaggctggagtgcagtggcgcaatctcggctcactgcaacttctgcctcctaggttcaagcagttctcctgcctcagcctcccaagtagttgggattacgggcatgcaccaccatgcctggataattttttcttatttttagtagagacaggatttcatcatgttggccatgctggtttcgaactcctgaccacatgtggtccacccaccttggcctcaattatgtgcattttggtatatttacttgtatttcaacatcttgtgagtttgaaaaacctgaaaggccagaatgcttccttttatttctcaccatttgggcagcacctaagtggttttgtaaaatgcagcatctggtgctgtgggtctctctcaggccttgagggacacttccttcctccccactcgcctcctctccactagactttggttcctagagggcgtggggccgggtctgaggttcttgcctgccttccctcccattggtctttggttgctcatccctctaactgcaccccttcttggtccttcctccacagacttcagataatagataagtcattagcaaaccagaccgaatctttagggtgaagagctccccaaagccatctggtgaggtcattgtggggaccagggactgattatttgtcacctggatcacaaagatgggactgtctgctcaggctggtggtgacaggatcctgacccgtggtcctctcccgctccctctgctccaccaggacacatgtataggacactgtgctgtgtgcagtggagaaatctccctgggccaggggaaagttcagacagtgcctctagattgtgttttgcctcctccaatgtagagttgacatctggaccccagagcccagcagggctttctgtcagacatgctagggtggtagaaatgggccctccaggtccccctgcagtgcactgggcagagacctccggaaagccggcagcgggagcgcttcctgggcagcttcccccagcacagtgttcccaaaccagtccatccggaaaacagtctgtacagcaaatgctgtgtgagatcttaggcttttcactttttttgttttgttttgtttttgaaagaaagaaaaaaatacaattaacaagcctcttttgtaaatgggtttcctttctatgtataaaatcgtggtggtcccttgtttttacatgttcatgctgtgtaattttgagatgttactgagatatgttctgaacataatgtgcatttttttctgtacagatgaaatgggagaatttaataaagagtttgcaggtttttacttgttaaatctt

SEQ ID NO: 72776 - DNA, 733 bp, Homo sapiens
agccagcccttgccgtggccggagccgagcggcgcatccgggccggagaagaggacgacgacgaggtcctcgaagtggacccgtttgcgaagcgccagggagaaggaggagcggacgcatcgtagaaaggggtggtggcgcccgaccccgcgccccggcccgaagctctgagggcttcccggcccccactgcctgcggcatggcccggggctcggcgctcccgcggcggccgctgctgtgcatcccggccgtctgggcggccgccgcgcttctgctctcagtgtcccggacttcaggtgaagtggaggttctggatccgaacgaccctttaggaccccttgatgggcaggacggcccgattccaactctgaaaggttactttctgaattttctggagccagtaaacaatatcaccattgtccaaggccagacggcaattctgcactgcaaggtggcaggaaacccaccccctaacgtgcggtggctaaagaatgatgccccggtggtgcaggagccgcggcggatcatcatccggaagacagaatatggttcacgactgcgaatccaggacctggacacgacagacactggctactaccagtgcgtggccaccaacgggatgaagaccattaccgccactggcgtcctgtttgtgcggctgggtccaacgcacagcccaaatcataactttcaagatggggtctcactatgctgtccagattctggtgacaaa

SEQ ID NO: 72777 - DNA, 4092 bp, Homo sapiens
agccagcccttgccgtggccggagccgagcggcgcatccgggccggagaagaggacgacgacgaggtcctcgaagtggacccgtttgcgaagcgccagggagaaggaggagcggacgcatcgtagaaaggggtggtggcgcccgaccccgcgccccggcccgaagctctgagggcttcccggcccccactgcctgcggcatggcccggggctcggcgctcccgcggcggccgctgctgtgcatcccggccgtctgggcggccgccgcgcttctgctctcagtgtcccggacttcaggtgaagtggaggttctggatccgaacgaccctttaggaccccttgatgggcaggacggcccgattccaactctgaaaggttactttctgaattttctggagccagtaaacaatatcaccattgtccaaggccagacggcaattctgcactgcaaggtggcaggaaacccaccccctaacgtgcggtggctaaagaatgatgccccggtggtgcaggagccgcggcggatcatcatccggaagacagaatatggttcacgactgcgaatccaggacctggacacgacagacactggctactaccagtgcgtggccaccaacgggatgaagaccattaccgccactggcgtcctgtttgtgcggctgggtccaacgcacagcccaaatcataactttcaggatgattaccacgaggatgggttctgccagccttaccggggaattgcctgtgcacgcttcattggcaaccggaccatttatgtggactcgcttcagatgcagggggagattgaaaaccgaatcacagcggccttcaccatgatcggcacgtctacgcacctgtcggaccagtgctcacagttcgccatcccatccttctgccacttcgtgtttcctctgtgcgacgcgcgctcccgggcacccaagccgcgtgagctgtgccgcgacgagtgcgaggtgctggagagcgacctgtgccgccaggagtacaccatcgcccgctccaacccgctcatcctcatgcggcttcagctgcccaagtgtgaggcgctgcccatgcctgagagccccgacgctgccaactgcatgcgcattggcatcccagccgagaggctgggccgctaccatcagtgctataacggctcaggcatggattacagaggaacggcaagcaccaccaagtcaggccaccagtgccagccgtgggccctgcagcacccccacagccaccacctgtccagcacagacttccctgagcttggaggggggcacgcctactgccggaaccccggaggccagatggagggcccctggtgctttacgcagaataaaaacgtacgcatggaactgtgtgacgtaccctcgtgtagtccccgagacagcagcaagatggggattctgtacatcttggtccccagcatcgcaattccactggtcatcgcttgccttttcttcttggtttgcatgtgccggaataagcagaaggcatctgcgtccacaccgcagcggcgacagctgatggcctcgcccagccaagacatggaaatgcccctcattaaccagcacaaacaggccaaactcaaagagatcagcctgtctgcggtgaggttcatggaggagctgggagaggaccggtttgggaaagtctacaaaggtcacctgttcggccctgccccgggggagcagacccaggctgtggccatcaaaacgctgaaggacaaagcggaggggcccctgcgggaggagttccggcatgaggctatgctgcgagcacggctgcaacaccccaacgtcgtctgcctgctgggcgtggtgaccaaggaccagcccctgagcatgatcttcagctactgttcgcacggcgacctccacgaattcctggtcatgcgctcgccgcactcggacgtgggcagcaccgatgatgaccgcacggtgaagtccgccctggagccccccgacttcgtgcaccttgtggcacagatcgcggcggggatggagtacctatccagccaccacgtggttcacaaggacctggccacccgcaatgtgctagtgtacgacaagctgaacgtgaagatctcagacttgggcctcttccgagaggtgtatgccgccgattactacaagctgctggggaactcgctgctgcctatccgctggatggccccagaggccatcatgtacggcaagttctccatcgactcagacatctggtcctacggtgtggtcctgtgggaggtcttcagctacggcctgcagccctactgcgggtactccaaccaggatgtggtggagatgatccggaaccggcaggtgctgccttgccccgatgactgtcccgcctgggtgtatgccctcatgatcgagtgctggaacgagttccccagccggcggccccgcttcaaggacatccacagccggctccgagcctggggcaacctttccaactacaacagctcggcgcagacctcgggggccagcaacaccacgcagaccagctccctgagcaccagcccagtgagcaatgtgagcaacgcccgctacgtggggcccaagcagaaggccccgcccttcccacagccccagttcatccccatgaagggccagatcagacccatggtgcccccgccgcagctctacgtccccgtcaacggctaccagccggtgccggcctatggggcctacctgcccaacttctacccggtgcagatcccaatgcagatggccccgcagcaggtgcctcctcagatggtccccaagcccagctcacaccacagtggcagtggctccaccagcacaggctacgtcaccacggccccctccaacacatccatggcagacagggcagccctgctctcagagggcgctgatgacacacagaacgccccagaagatggggcccagagcaccgtgcaggaagcagaggaggaggaggaaggctctgtcccagagactgagctgctgggggactgtgacactctgcaggtggacgaggcccaagtccagctggaagcttgagtggcaccagggcccggggttcggggatagaagccccgccgagaccccacagggacctcagtcacctttgagaagacaccatactcagcaatcacaagagcccgccggccagtgggcttgtttgcagactgggtgaggtggagccctgctcctctctgtcctctgacacagagagctgccctgcctaggagcacccaagccaggcagggggtctggcagcacggcgtcctggggagcaggacacatggtcatccccagggctgtatacattgattctggtggtagactggtagtgagcagcaaatgcctttcaagaaaataggtggcagcttcactccatgtcatatatggagtgaatatttcaaaacgttgggaataagggcctgcaaaaggcagcgaggaggcacctcgggtcttgaggttcctgacaaccgatctggtctgttggtttgaggatgaaggggctccatttctgctgcctccctgctgagaatattctccctttagcagccaaagattcgctggaacggaggctgccctctgctgcctgttggggtcggaagacaaggggcttctgaaatgggagttcctgagatacaacaaaatgtgtgccttcaaagaaactgacagctttgtatttggtgaaatggttttaattatactccatgtgtattttgcccactttttttgggaattcaagggaaagtgtttcttgggtttggaatgttcagaggaagcagtattgtacagaacacggtattgttatttttgttaagaatcatgtacagagcttaaatgtaatttatatgtttttaatatgccattttcattgaagtattttggtcttaagatgactttagtaatttaactgtttatgttacccacgttgggatccagttggtcttggtttgcttctctctgtaccacgtgcacatgaggtccattcattttacagcccctgttacacacagacccacaggcagccgtctgtgcccgcacacattgttggtcctatttgtaaatcccacacccggtgtatccaataaagtgaaaccaacccc

SEQ ID NO: 72778 - DNA, 572 bp, Homo sapiens
agccagcccttgccgtggccggagccgagcggcgcatccgggccggagaagaggacgacgacgaggtcctcgaagtggacccgtttgcgaagcgccagggagaaggaggagcggacgcatcgtagaaaggggtggtggcgcccgaccccgcgccccggcccgaagctctgagggcttcccggcccccactgcctgcggcatggcccggggctcggcgctcccgcggcggccgctgctgtgcatcccggccgtctgggcggccgccgcgcttctgctctcagtgtcccggacttcaggagccacacaggacagttgacccaacacttctgccacctgaagaacgacacctgcattcctccatctctgggaccaccaaggaactcagggagcttggaatctctcagatcaaaaagatactgactcatcggatagccatgccatcctgaaaacggccttccttgtgtgtacattatttgcaacaagcaacaagtttataagcactttggtaaaattgcatgtgagggttaaaatattaaagtcagtgcgtcaacttgaaataaatgatgagttat

SEQ ID NO: 72779 - DNA, 4334 bp, Homo sapiens
gggtggaggagggcgggcggggccttcaggcccaggagcgccagagacctatggggttcgcctgaagcccccggaatgtgtgagacacttcttactagtaaatgggcttcagtatcccccatccctgcactcctgcaggaaggtgagaatcgggacagtcgcaggctgggagacgctctgcttttcctgcgtcctgctgggagctgcgcgctccaggtatcctggcctgccgccctagccggcccaaggagccacacaggacagttgacccaacacttctgccacctgaagaacgacacctgcattcctccatctctgggaccaccaaggaactcagggagcttggaatctctcagatcaaaaagatactgactcatcggatagccatgccatcctgaaaacggccttcctttgaagaaaatgtgagtgggaaacatgaagagtgatgaaatgaacaagttgagtgactcccaccctgttgaagagattgaacttcatccccagttcctgtgaagctttctggatctcgtcttccaaggtgaagtggaggttctggatccgaacgaccctttaggaccccttgatgggcaggacggcccgattccaactctgaaaggttactttctgaattttctggagccagtaaacaatatcaccattgtccaaggccagacggcaattctgcactgcaaggtggcaggaaacccaccccctaacgtgcggtggctaaagaatgatgccccggtggtgcaggagccgcggcggatcatcatccggaagacagaatatggttcacgactgcgaatccaggacctggacacgacagacactggctactaccagtgcgtggccaccaacgggatgaagaccattaccgccactggcgtcctgtttgtgcggctgggtccaacgcacagcccaaatcataactttcaggatgattaccacgaggatgggttctgccagccttaccggggaattgcctgtgcacgcttcattggcaaccggaccatttatgtggactcgcttcagatgcagggggagattgaaaaccgaatcacagcggccttcaccatgatcggcacgtctacgcacctgtcggaccagtgctcacagttcgccatcccatccttctgccacttcgtgtttcctctgtgcgacgcgcgctcccgggcacccaagccgcgtgagctgtgccgcgacgagtgcgaggtgctggagagcgacctgtgccgccaggagtacaccatcgcccgctccaacccgctcatcctcatgcggcttcagctgcccaagtgtgaggcgctgcccatgcctgagagccccgacgctgccaactgcatgcgcattggcatcccagccgagaggctgggccgctaccatcagtgctataacggctcaggcatggattacagaggaacggcaagcaccaccaagtcaggccaccagtgccagccgtgggccctgcagcacccccacagccaccacctgtccagcacagacttccctgagcttggaggggggcacgcctactgccggaaccccggaggccagatggagggcccctggtgctttacgcagaataaaaacgtacgcatggaactgtgtgacgtaccctcgtgtagtccccgagacagcagcaagatggggattctgtacatcttggtccccagcatcgcaattccactggtcatcgcttgccttttcttcttggtttgcatgtgccggaataagcagaaggcatctgcgtccacaccgcagcggcgacagctgatggcctcgcccagccaagacatggaaatgcccctcattaaccagcacaaacaggccaaactcaaagagatcagcctgtctgcggtgaggttcatggaggagctgggagaggaccggtttgggaaagtctacaaaggtcacctgttcggccctgccccgggggagcagacccaggctgtggccatcaaaacgctgaaggacaaagcggaggggcccctgcgggaggagttccggcatgaggctatgctgcgagcacggctgcaacaccccaacgtcgtctgcctgctgggcgtggtgaccaaggaccagcccctgagcatgatcttcagctactgttcgcacggcgacctccacgaattcctggtcatgcgctcgccgcactcggacgtgggcagcaccgatgatgaccgcacggtgaagtccgccctggagccccccgacttcgtgcaccttgtggcacagatcgcggcggggatggagtacctatccagccaccacgtggttcacaaggacctggccacccgcaatgtgctagtgtacgacaagctgaacgtgaagatctcagacttgggcctcttccgagaggtgtatgccgccgattactacaagctgctggggaactcgctgctgcctatccgctggatggccccagaggccatcatgtacggcaagttctccatcgactcagacatctggtcctacggtgtggtcctgtgggaggtcttcagctacggcctgcagccctactgcgggtactccaaccaggatgtggtggagatgatccggaaccggcaggtgctgccttgccccgatgactgtcccgcctgggtgtatgccctcatgatcgagtgctggaacgagttccccagccggcggccccgcttcaaggacatccacagccggctccgagcctggggcaacctttccaactacaacagctcggcgcagacctcgggggccagcaacaccacgcagaccagctccctgagcaccagcccagtgagcaatgtgagcaacgcccgctacgtggggcccaagcagaaggccccgcccttcccacagccccagttcatccccatgaagggccagatcagacccatggtgcccccgccgcagctctacgtccccgtcaacggctaccagccggtgccggcctatggggcctacctgcccaacttctacccggtgcagatcccaatgcagatggccccgcagcaggtgcctcctcagatggtccccaagcccagctcacaccacagtggcagtggctccaccagcacaggctacgtcaccacggccccctccaacacatccatggcagacagggcagccctgctctcagagggcgctgatgacacacagaacgccccagaagatggggcccagagcaccgtgcaggaagcagaggaggaggaggaaggctctgtcccagagactgagctgctgggggactgtgacactctgcaggtggacgaggcccaagtccagctggaagcttgagtggcaccagggcccggggttcggggatagaagccccgccgagaccccacagggacctcagtcacctttgagaagacaccatactcagcaatcacaagagcccgccggccagtgggcttgtttgcagactgggtgaggtggagccctgctcctctctgtcctctgacacagagagctgccctgcctaggagcacccaagccaggcagggggtctggcagcacggcgtcctggggagcaggacacatggtcatccccagggctgtatacattgattctggtggtagactggtagtgagcagcaaatgcctttcaagaaaataggtggcagcttcactccatgtcatatatggagtgaatatttcaaaacgttgggaataagggcctgcaaaaggcagcgaggaggcacctcgggtcttgaggttcctgacaaccgatctggtctgttggtttgaggatgaaggggctccatttctgctgcctccctgctgagaatattctccctttagcagccaaagattcgctggaacggaggctgccctctgctgcctgttggggtcggaagacaaggggcttctgaaatgggagttcctgagatacaacaaaatgtgtgccttcaaagaaactgacagctttgtatttggtgaaatggttttaattatactccatgtgtattttgcccactttttttgggaattcaagggaaagtgtttcttgggtttggaatgttcagaggaagcagtattgtacagaacacggtattgttatttttgttaagaatcatgtacagagcttaaatgtaatttatatgtttttaatatgccattttcattgaagtattttggtcttaagatgactttagtaatttaactgtttatgttacccacgttgggatccagttggtcttggtttgcttctctctgtaccacgtgcacatgaggtccattcattttacagcccctgttacacacagacccacaggcagccgtctgtgcccgcacacattgttggtcctatttgtaaatcccacacccggtgtatccaataaagtgaaaccaacccc

SEQ ID NO: 72780 - DNA, 3434 bp, Homo sapiens
ccatgattctgaggcctccacagccatgtggaactggatgattaccacgaggatgggttctgccagccttaccggggaattgcctgtgcacgcttcattggcaaccggaccatttatgtggactcgcttcagatgcagggggagattgaaaaccgaatcacagcggccttcaccatgatcggcacgtctacgcacctgtcggaccagtgctcacagttcgccatcccatccttctgccacttcgtgtttcctctgtgcgacgcgcgctcccgggcacccaagccgcgtgagctgtgccgcgacgagtgcgaggtgctggagagcgacctgtgccgccaggagtacaccatcgcccgctccaacccgctcatcctcatgcggcttcagctgcccaagtgtgaggcgctgcccatgcctgagagccccgacgctgccaactgcatgcgcattggcatcccagccgagaggctgggccgctaccatcagtgctataacggctcaggcatggattacagaggaacggcaagcaccaccaagtcaggccaccagtgccagccgtgggccctgcagcacccccacagccaccacctgtccagcacagacttccctgagcttggaggggggcacgcctactgccggaaccccggaggccagatggagggcccctggtgctttacgcagaataaaaacgtacgcatggaactgtgtgacgtaccctcgtgtagtccccgagacagcagcaagatggggattctgtacatcttggtccccagcatcgcaattccactggtcatcgcttgccttttcttcttggtttgcatgtgccggaataagcagaaggcatctgcgtccacaccgcagcggcgacagctgatggcctcgcccagccaagacatggaaatgcccctcattaaccagcacaaacaggccaaactcaaagagatcagcctgtctgcggtgaggttcatggaggagctgggagaggaccggtttgggaaagtctacaaaggtcacctgttcggccctgccccgggggagcagacccaggctgtggccatcaaaacgctgaaggacaaagcggaggggcccctgcgggaggagttccggcatgaggctatgctgcgagcacggctgcaacaccccaacgtcgtctgcctgctgggcgtggtgaccaaggaccagcccctgagcatgatcttcagctactgttcgcacggcgacctccacgaattcctggtcatgcgctcgccgcactcggacgtgggcagcaccgatgatgaccgcacggtgaagtccgccctggagccccccgacttcgtgcaccttgtggcacagatcgcggcggggatggagtacctatccagccaccacgtggttcacaaggacctggccacccgcaatgtgctagtgtacgacaagctgaacgtgaagatctcagacttgggcctcttccgagaggtgtatgccgccgattactacaagctgctggggaactcgctgctgcctatccgctggatggccccagaggccatcatgtacggcaagttctccatcgactcagacatctggtcctacggtgtggtcctgtgggaggtcttcagctacggcctgcagccctactgcgggtactccaaccaggatgtggtggagatgatccggaaccggcaggtgctgccttgccccgatgactgtcccgcctgggtgtatgccctcatgatcgagtgctggaacgagttccccagccggcggccccgcttcaaggacatccacagccggctccgagcctggggcaacctttccaactacaacagctcggcgcagacctcgggggccagcaacaccacgcagaccagctccctgagcaccagcccagtgagcaatgtgagcaacgcccgctacgtggggcccaagcagaaggccccgcccttcccacagccccagttcatccccatgaagggccagatcagacccatggtgcccccgccgcagctctacgtccccgtcaacggctaccagccggtgccggcctatggggcctacctgcccaacttctacccggtgcagatcccaatgcagatggccccgcagcaggtgcctcctcagatggtccccaagcccagctcacaccacagtggcagtggctccaccagcacaggctacgtcaccacggccccctccaacacatccatggcagacagggcagccctgctctcagagggcgctgatgacacacagaacgccccagaagatggggcccagagcaccgtgcaggaagcagaggaggaggaggaaggctctgtcccagagactgagctgctgggggactgtgacactctgcaggtggacgaggcccaagtccagctggaagcttgagtggcaccagggcccggggttcggggatagaagccccgccgagaccccacagggacctcagtcacctttgagaagacaccatactcagcaatcacaagagcccgccggccagtgggcttgtttgcagactgggtgaggtggagccctgctcctctctgtcctctgacacagagagctgccctgcctaggagcacccaagccaggcagggggtctggcagcacggcgtcctggggagcaggacacatggtcatccccagggctgtatacattgattctggtggtagactggtagtgagcagcaaatgcctttcaagaaaataggtggcagcttcactccatgtcatatatggagtgaatatttcaaaacgttgggaataagggcctgcaaaaggcagcgaggaggcacctcgggtcttgaggttcctgacaaccgatctggtctgttggtttgaggatgaaggggctccatttctgctgcctccctgctgagaatattctccctttagcagccaaagattcgctggaacggaggctgccctctgctgcctgttggggtcggaagacaaggggcttctgaaatgggagttcctgagatacaacaaaatgtgtgccttcaaagaaactgacagctttgtatttggtgaaatggttttaattatactccatgtgtattttgcccactttttttgggaattcaagggaaagtgtttcttgggtttggaatgttcagaggaagcagtattgtacagaacacggtattgttatttttgttaagaatcatgtacagagcttaaatgtaatttatatgtttttaatatgccattttcattgaagtattttggtcttaagatgactttagtaatttaactgtttatgttacccacgttgggatccagttggtcttggtttgcttctctctgtaccacgtgcacatgaggtccattcattttacagcccctgttacacacagacccacaggcagccgtctgtgcccgcacacattgttggtcctatttgtaaatcccacacccggtgtatccaataaagtgaaaccaacccc

SEQ ID NO: 72781 - DNA, 723 bp, Homo sapiens
agccagcccttgccgtggccggagccgagcggcgcatccgggccggagaagaggacgacgacgaggtcctcgaagtggacccgtttgcgaagcgccagggagaaggaggagcggacgcatcgtagaaaggggtggtggcgcccgaccccgcgccccggcccgaagctctgagggcttcccggcccccactgcctgcggcatggcccggggctcggcgctcccgcggcggccgctgctgtgcatcccggccgtctgggcggccgccgcgcttctgctctcagtgtcccggacttcaggtgaagtggaggttctggatccgaacgaccctttaggaccccttgatgggcaggacggcccgattccaactctgaaaggttactttctgaattttctggagccagtaaacaatatcaccattgtccaaggccagacggcaattctgcactgcaaggtggcaggaaacccaccccctaacgtgcggtggctaaagaatgatgccccggtggtccaacgcacagcccaaatcataactttcagtaagtatctgttttccccaagccatgttctgctgctctgagggtttttgttatgtaggaatccggggtttaaatcctgccagctcatgtctttgccgaatttgctagaagttggctgggcttcacacaggggtggccacgtgcttgcttagggttgggaaacatttacatttttcatgtttcttgt

SEQ ID NO: 72782 - DNA, 582 bp, Homo sapiens
ctgatgttgggagtggggacaaaggataggaaaagggctgggcagcaggagggatcacctaccatggaggacaaagaccttgccctcaagtgtccctcccattcatggagtaccagctcagttctactcagtgcagacaggcagcagaacagcagcttggggagagcaggaaagaatcagctgccaatgttgtagtggagacggatttcagggcctgatgagggtccaagtatggactgcaattgggatgcatgagaacatcctcaaaccctggaataggaaggcacccatgtgccctgatttctcctcggctctcattccaggagccacacaggacagttgacccaacacttctgccacctgaagaacgacacctgcattcctccatctctgggaccaccaaggaactcagggagcttggaatctctcagatcaaaaagatactgactcatcggatagccatgccatcctgaaaacggccttccttgtgtgtacattatttgcaacaagcaacaagtttataagcactttggtaaaattgcatgtgagggttaaaatattaaagtcagtgcgtcaacttga

SEQ ID NO: 72783 - DNA, 524 bp, Homo sapiens
gggtggaggagggcgggcggggccttcaggcccaggagcgccagagacctatggggttcgcctgaagcccccggaatgtgtgagacacttcttactagtaaatgggcttcagtatcccccatccctgcactcctgcaggaaggtgagaatcgggacagtcgcaggctgggagacgctctgcttttcctgcgtcctgctgggagctgcgcgctccaggtatcctggcctgccgccctagccggcccaaggagccacacaggacagttgacccaacacttctgccacctgaagaacgacacctgcattcctccatctctgggaccaccaaggaactcagggagcttggaatctctcagatcaaaaagatactgactcatcggatagccatgccatcctgaaaacggccttccttgtgtgtacattatttgcaacaagcaacaagtttataagcactttggtaaaattgcatgtgagggttaaaatattaaagtcagtgcgtcaacttgaaataaatgatgagttat

SEQ ID NO: 72784 - DNA, 4044 bp, Homo sapiens
gggtggaggagggcgggcggggccttcaggcccaggagcgccagagacctatggggttcgcctgaagcccccggaatgtgtgagacacttcttactagtaaatgggcttcagtatcccccatccctgcactcctgcaggaaggtgagaatcgggacagtcgcaggctgggagacgctctgcttttcctgcgtcctgctgggagctgcgcgctccaggtatcctggcctgccgccctagccggcccaaggtgaagtggaggttctggatccgaacgaccctttaggaccccttgatgggcaggacggcccgattccaactctgaaaggttactttctgaattttctggagccagtaaacaatatcaccattgtccaaggccagacggcaattctgcactgcaaggtggcaggaaacccaccccctaacgtgcggtggctaaagaatgatgccccggtggtgcaggagccgcggcggatcatcatccggaagacagaatatggttcacgactgcgaatccaggacctggacacgacagacactggctactaccagtgcgtggccaccaacgggatgaagaccattaccgccactggcgtcctgtttgtgcggctgggtccaacgcacagcccaaatcataactttcaggatgattaccacgaggatgggttctgccagccttaccggggaattgcctgtgcacgcttcattggcaaccggaccatttatgtggactcgcttcagatgcagggggagattgaaaaccgaatcacagcggccttcaccatgatcggcacgtctacgcacctgtcggaccagtgctcacagttcgccatcccatccttctgccacttcgtgtttcctctgtgcgacgcgcgctcccgggcacccaagccgcgtgagctgtgccgcgacgagtgcgaggtgctggagagcgacctgtgccgccaggagtacaccatcgcccgctccaacccgctcatcctcatgcggcttcagctgcccaagtgtgaggcgctgcccatgcctgagagccccgacgctgccaactgcatgcgcattggcatcccagccgagaggctgggccgctaccatcagtgctataacggctcaggcatggattacagaggaacggcaagcaccaccaagtcaggccaccagtgccagccgtgggccctgcagcacccccacagccaccacctgtccagcacagacttccctgagcttggaggggggcacgcctactgccggaaccccggaggccagatggagggcccctggtgctttacgcagaataaaaacgtacgcatggaactgtgtgacgtaccctcgtgtagtccccgagacagcagcaagatggggattctgtacatcttggtccccagcatcgcaattccactggtcatcgcttgccttttcttcttggtttgcatgtgccggaataagcagaaggcatctgcgtccacaccgcagcggcgacagctgatggcctcgcccagccaagacatggaaatgcccctcattaaccagcacaaacaggccaaactcaaagagatcagcctgtctgcggtgaggttcatggaggagctgggagaggaccggtttgggaaagtctacaaaggtcacctgttcggccctgccccgggggagcagacccaggctgtggccatcaaaacgctgaaggacaaagcggaggggcccctgcgggaggagttccggcatgaggctatgctgcgagcacggctgcaacaccccaacgtcgtctgcctgctgggcgtggtgaccaaggaccagcccctgagcatgatcttcagctactgttcgcacggcgacctccacgaattcctggtcatgcgctcgccgcactcggacgtgggcagcaccgatgatgaccgcacggtgaagtccgccctggagccccccgacttcgtgcaccttgtggcacagatcgcggcggggatggagtacctatccagccaccacgtggttcacaaggacctggccacccgcaatgtgctagtgtacgacaagctgaacgtgaagatctcagacttgggcctcttccgagaggtgtatgccgccgattactacaagctgctggggaactcgctgctgcctatccgctggatggccccagaggccatcatgtacggcaagttctccatcgactcagacatctggtcctacggtgtggtcctgtgggaggtcttcagctacggcctgcagccctactgcgggtactccaaccaggatgtggtggagatgatccggaaccggcaggtgctgccttgccccgatgactgtcccgcctgggtgtatgccctcatgatcgagtgctggaacgagttccccagccggcggccccgcttcaaggacatccacagccggctccgagcctggggcaacctttccaactacaacagctcggcgcagacctcgggggccagcaacaccacgcagaccagctccctgagcaccagcccagtgagcaatgtgagcaacgcccgctacgtggggcccaagcagaaggccccgcccttcccacagccccagttcatccccatgaagggccagatcagacccatggtgcccccgccgcagctctacgtccccgtcaacggctaccagccggtgccggcctatggggcctacctgcccaacttctacccggtgcagatcccaatgcagatggccccgcagcaggtgcctcctcagatggtccccaagcccagctcacaccacagtggcagtggctccaccagcacaggctacgtcaccacggccccctccaacacatccatggcagacagggcagccctgctctcagagggcgctgatgacacacagaacgccccagaagatggggcccagagcaccgtgcaggaagcagaggaggaggaggaaggctctgtcccagagactgagctgctgggggactgtgacactctgcaggtggacgaggcccaagtccagctggaagcttgagtggcaccagggcccggggttcggggatagaagccccgccgagaccccacagggacctcagtcacctttgagaagacaccatactcagcaatcacaagagcccgccggccagtgggcttgtttgcagactgggtgaggtggagccctgctcctctctgtcctctgacacagagagctgccctgcctaggagcacccaagccaggcagggggtctggcagcacggcgtcctggggagcaggacacatggtcatccccagggctgtatacattgattctggtggtagactggtagtgagcagcaaatgcctttcaagaaaataggtggcagcttcactccatgtcatatatggagtgaatatttcaaaacgttgggaataagggcctgcaaaaggcagcgaggaggcacctcgggtcttgaggttcctgacaaccgatctggtctgttggtttgaggatgaaggggctccatttctgctgcctccctgctgagaatattctccctttagcagccaaagattcgctggaacggaggctgccctctgctgcctgttggggtcggaagacaaggggcttctgaaatgggagttcctgagatacaacaaaatgtgtgccttcaaagaaactgacagctttgtatttggtgaaatggttttaattatactccatgtgtattttgcccactttttttgggaattcaagggaaagtgtttcttgggtttggaatgttcagaggaagcagtattgtacagaacacggtattgttatttttgttaagaatcatgtacagagcttaaatgtaatttatatgtttttaatatgccattttcattgaagtattttggtcttaagatgactttagtaatttaactgtttatgttacccacgttgggatccagttggtcttggtttgcttctctctgtaccacgtgcacatgaggtccattcattttacagcccctgttacacacagacccacaggcagccgtctgtgcccgcacacattgttggtcctatttgtaaatcccacacccggtgtatccaataaagtgaaaccaacccc

SEQ ID NO: 72785 - DNA, 554 bp, Homo sapiens
agcattgattgagaaccctgtttcatgtatgatatcagaagctggaaactctatcagtgaatccttggttttcttatgactcacaaagaatttcacataaagtaagagaaaatcttgcttagtaacagtctgcactacatataataatagaacacaatttgtatgtgaaagtagtaagatatacttcattcataaaaagcaccatgcttctggctagataaatgatttgaagtcccagagagaaattgcaatttttagttctgggatacccttatgctacttacactttttaaaatttaatacattcacgtgtttaaatgtattgagatttttaagcttgtgaatgaaattagcatcgtgctgtggctgtcaacgtgatgcactgcaattccccctgagtggtagggtttaaatattaattcagctcttgcacctgtttgccagcattcggctgttgaatttccatcacatttaataagtctcggtgacgcaacccatgtccttttgcctgggctcctttaatatagtgttaaattctcacccatctgaaattc

SEQ ID NO: 72786 - DNA, 425 bp, Homo sapiens
atcaaatattcttagtgtagccatccatttacaagtgttattttcaagagcaaaatttatgcctttaaactgtgataattaaattaatactggtgagaactatcagatataccactgtgacagaacagatggcctagagacagtgatacctttaaaagttaaataattgctgagcgcggtggcttacgcctgtaatcccagcactttgggaggccgcggtgtgtggatcacggggtcaggagttcaagaccagcctggccaagatggtgaaaccccatctctactaaaaatacaggtgggcgcctataatcccagctactcaggaggctgaggcagagaattgcttgaacccaggaggcggaggttgcagtgagccaagatcgcgccactgcactccagcctaggtgacagcgagactccgtctc

SEQ ID NO: 72787 - DNA, 317 bp, Homo sapiens
atatggattctagtaccaccattgccgacattgatttgctctttggcctttggcaaatcgctttgcccaaagtcactttgttctctgatcactaattttctccattaaaaaaaaaaaagtctcagccgggcacagtggctcacacctgtaatcccagcactttgggaggccaaggcgggtggatcacgaggtcaggagtttgagaccagcctggcaaagatagtgaaaccccatctctactaaaaatacagctgggcgtggtggcatgtgcctatagtcccagctactcaggaggctgaggcaggagaatcacttga

SEQ ID NO: 72788 - DNA, 871 bp, Homo sapiens
ttggggtaggttttgccctttttaagatccacatgaaatctttcgcctccgaagttcgagggtaactttcgttccctcctggccttcgcgacaccctcgagtcggacggaggccgagtcgtgtcctcacccccagcagcctgcggcggccgggacccccggaggcccttcttccgctccttggaaacttaaaatgtggggtgagggagagacgcgttacgtttgacagaccggtgaaattaaagacactcaagcttctcagagtgatttgaagaaatgctcagcgttctgccgaaatatagttttaagtttttaaaccacggcatggtttttaaaggctgaaggacccacagtttttttctcttaaagggcacgcattcattttgattaatatttcttaacatgcagccaaagccaggactcgggctcactgctgcaggggtgtcctcgggaagtcccgaggggggaaaggcgcgcaagcctgaaatggagatgaaaataaacaggcataatatttgctacctcactgcgttgggcgtagtagtaactaattcttaaaaaacgtcttagatgacatataagtagtaaagccgttgtatgctaatctagaatttttgagaaaaacttaatcacccaaatgtttgctataatgtgatgaagatagcatccatcggcagtagccaggatcaaatgacgagtagatatggttataaatggggcccatgcagtataattagtatatgaaaccaagatgtcagtcctcacacagaatttgtgtaatgatatgcatttgggaggcttcaggccttttcagctatttgatacaggttgattcttactgaatacagaataataaaaaatgaattactggt

SEQ ID NO: 72789 - DNA, 406 bp, Homo sapiens
acaaaaagctgcacatatttaatgtatcctattgtgtaattaatttttaatttttttgtgtacttcctaaacttatagtcctgcgagtctgggaacagatctgtttttcacttatcctgatttaatgacagtttccaacattgttttgttattacaagtaggggatctttttttttgcccgtttaatgaagatactaaaaataatgcactggaaggagtggaagagttggaaaatttgtaaccatcataatacaggtgtaataggtttgggaaagaatcctcaaaaatgttaaagcaagggaggaaagtttgttgagaagcaagatgttcttctctcctgcccgcccccgcggttggttgttggtggtcagaattattgtgtaataaataatagacattttttctt

SEQ ID NO: 72790 - DNA, 179 bp, Homo sapiens
ccggccatttgtaggatttctaaaaggaagctgctattattcattcctgtcttatgggggagctgcaggctcagcgagggcaaagctgcacagcaaacagcagcacttgaacatgtctgccgggtctcagcgccagggatacagctgagccaggacgttcccggcccccacagtgtgca

SEQ ID NO: 72791 - DNA, 1228 bp, Homo sapiens
agcggtgcgatggcgcggtcttggctcactgcaacctccgctcgctgcaacccccgtctctactgaaaatgcaaaaaattagccgggcagggtggcgggcgcctgtggtcccagctactccgaggctgaagcaggagaatggcgtcaagcggcgaggcggagcttgcggtgagccgagatcgtgccgctgcactccagcctgggcaacagagcaagactccatctcaaaaagaaaaaaaaagtagagatgggatctctagcctcctaagttaatttagcctcccaaatgccagacaaagaatctaacataaaatttaccttgaataagatatatgatattgattctgagctgctttgtattttttctgactttggcatctgtatcttggtgctttctgttagactggtagagtttaagaacctaaggagtatgcattgtacttcagtgctaacttttttcttcatttactttctgtgtatataggcagcatattttttttgtagaacattaacccagattgctaatagcttcatgttacggcattcttccacacagtccagattgatttaaggaaaagcagaaatggaagtcaaagtgtgttataaattgagactgaaaaacatgctttaaaaaatagatttaatttcttacactgtgaatagccattgtattgttttgtttctgataaatcagttgttttgggcccctatttttgaactgttaaaaaattttgatgcttttcgtggataaaagtagtgcctctctttatacaactgatggggttttaaaaagtgtaaattgccttttttgttaaacttattttaaatgctttagtatttaaagggtgtatgttattaattaatctgcatatttgtaacgcaaataactacttcctgatttacatctcaatatattcttctttcatttgcccaatttaaaaaatacgtagtctctattgttgctgtttactaatagttttagatcccaatgtgtattagaattatagctacaaaaagttgcaagtaaaatttagcaatttcctattcaaacaggatctcattagtatgttttttaatgtgtagaattaacactttaaaataaacaggtgtgaaaattataaaggaatatatatgacaattattttctgtacattaatgtctaaacattatacttactttttcataataaaggaaattttggaaccaaatttgctgagtttagcataaa

SEQ ID NO: 72792 - DNA, 1414 bp, Homo sapiens
tctgatagattagttcaagtgattctcctgcctcagcctccggagtggctgggattacaggcacctgccaccaagcacggctaattttgtatttttagtagaaacggggtttcgccatgtggccaggctggtctcgaactcctgacctcagatgatccactcaccccagcacttgggaggctgaggcaggcagatcacgaggtcaggagatcgagatctcttggctaacacggtgaaacccgtctctactgaaaatgcaaaaaattagccgggcagggtggcgggcgcctgtggtcccagctactccgaggctgaagcaggagaatggcgtcaagcggcgaggcggagcttgcggtgagccgagatcgtgccgctgcactccagcctgggcaacagagcaagactccatctcaaaaagaaaaaaaaagtagagatgggatctctagcctcctaagttaatttagcctcccaaatgccagacaaagaatctaacataaaatttaccttgaataagatatatgatattgattctgagctgctttgtattttttctgactttggcatctgtatcttggtgctttctgttagactggtagagtttaagaacctaaggagtatgcattgtacttcagtgctaacttttttcttcatttactttctgtgtatataggcagcatattttttttgtagaacattaacccagattgctaatagcttcatgttacggcattcttccacacagtccagattgatttaaggaaaagcagaaatggaagtcaaagtgtgttataaattgagactgaaaaacatgctttaaaaaatagatttaatttcttacactgtgaatagccattgtattgttttgtttctgataaatcagttgttttgggcccctatttttgaactgttaaaaaattttgatgcttttcgtggataaaagtagtgcctctctttatacaactgatggggttttaaaaagtgtaaattgccttttttgttaaacttattttaaatgctttagtatttaaagggtgtatgttattaattaatctgcatatttgtaacgcaaataactacttcctgatttacatctcaatatattcttctttcatttgcccaatttaaaaaatacgtagtctctattgttgctgtttactaatagttttagatcccaatgtgtattagaattatagctacaaaaagttgcaagtaaaatttagcaatttcctattcaaacaggatctcattagtatgttttttaatgtgtagaattaacactttaaaataaacaggtgtgaaaattataaaggaatatatatgacaattattttctgtacattaatgtctaaacattatacttactttttcataataaaggaaattttggaaccaaatttgctgagtttagcataaa

SEQ ID NO: 72793 - DNA, 1085 bp, Homo sapiens
caggcatgagccaccatgcccagctaattttttaatttttctgtagaggtagggtcctgggcaacagagcaagactccatctcaaaaagaaaaaaaaagtagagatgggatctctagcctcctaagttaatttagcctcccaaatgccagacaaagaatctaacataaaatttaccttgaataagatatatgatattgattctgagctgctttgtattttttctgactttggcatctgtatcttggtgctttctgttagactggtagagtttaagaacctaaggagtatgcattgtacttcagtgctaacttttttcttcatttactttctgtgtatataggcagcatattttttttgtagaacattaacccagattgctaatagcttcatgttacggcattcttccacacagtccagattgatttaaggaaaagcagaaatggaagtcaaagtgtgttataaattgagactgaaaaacatgctttaaaaaatagatttaatttcttacactgtgaatagccattgtattgttttgtttctgataaatcagttgttttgggcccctatttttgaactgttaaaaaattttgatgcttttcgtggataaaagtagtgcctctctttatacaactgatggggttttaaaaagtgtaaattgccttttttgttaaacttattttaaatgctttagtatttaaagggtgtatgttattaattaatctgcatatttgtaacgcaaataactacttcctgatttacatctcaatatattcttctttcatttgcccaatttaaaaaatacgtagtctctattgttgctgtttactaatagttttagatcccaatgtgtattagaattatagctacaaaaagttgcaagtaaaatttagcaatttcctattcaaacaggatctcattagtatgttttttaatgtgtagaattaacactttaaaataaacaggtgtgaaaattataaaggaatatatatgacaattattttctgtacattaatgtctaaacattatacttactttttcataataaaggaaattttggaaccaaatttgctgagtttagcataaa

SEQ ID NO: 72794 - DNA, 1206 bp, Homo sapiens
agcggtgcgatggcgcggtcttggctcactgcaacctccgctcgctgcaacccccgtctctactgaaaatgcaaaaaattagccgggcagggtggcgggcgcctgtggtcccagctactccgaggctgaagcaggagaatggcgtcaagcggcgaggcggagcttgcggtgagccgagatcgtgccgctgcactccagcctgggcaacagagcaagactccatctcaaaaagaaaaaaaaagtagagatgggatctctagcctcctaagttaatttagcctcccaaatgccagacaaagaatctaacataaaatttaccttgaataagatatatgatattgattctgagctgctttgtattttttctgactttggcatctgtatcttggtgctttctgttagactggtagagtttaagaacctaaggagtatgcattgtacttcagtgctaacttttttcttcatttactttctgtgtatataggcagcatattttttttgtagaacattaacccagattgctaatagcttcatgttacggcattcttccacacagtccagattgatttaaggaaaagcagaaatggaagtcaaagtgtgttataaattgagactgaaaaacatgctttaaaaaatagatttaatttcttacactgtgaatagccattgtattgttttgtttctgataaatcagttgttttgggcccctatttttgaactgttaaaaaattttgatgcttttcgtggataaaagtagtgcctctctttatacaactgatggggttttaaaaagtgtaaattgccttttttgttaaacttattttaaatgctttagtatttaaagggtgtatgttattaattaatctgcatatttgtaacgcaaataactacttcctgatttacatctcaatatattcttctttcatttgcccaatttaaaaaatacgtagtctctattgttgctgtttactaatagttttagatcccaatgtgtattagaattatagctacaaaaagttgcaagtaaaatttagcaatttcctattcaaacaggatctcattagtatgttttttaatgtgtagaattaacactttaaaatacacccgtagccccccatagccacgttcactcatgtgtatccagttgagtagcttaaggttcttcctttattgttttttttttgtaaaaaaaaagcttcaggttcc

SEQ ID NO: 72795 - DNA, 408 bp, Homo sapiens
acacttgggtcatcttcatccacacacaagtcctccagccttggggcagccatagcagatcacaccaggagtgcggcccagcagccgtggctgaaaggctgcctttaccacatttccttccatcccccccatggcaggtcttcctttatactgtactgcattagacactccactaggcactgagggcacccttcccatctggggccacaggcttgaaatagagtggttgacagggtgccctaacccagctgggacaggcaggtcagcttgccagccatgcctgggtcctgagggcagagtcaggagacaggtctgccttgacccccagggcagcaggcttttacctggcctctgggtcatctctgtctgcccagccctggtcctcatccgctgccttctcctcacccc

SEQ ID NO: 72796 - DNA, 393 bp, Homo sapiens
tgtaagtcatttgtagataaaatgtacttagggagtgcctactaagtgtgagatgctatcatagctgggagaagggaaggggtaggagtaacaatggaggagtgggttagtagaacagcccccatttcaggaaaactatattttattagggagatatatgtgcacaggactatttctatggcaaggcataaaacagcgcatgcctcagtagtaaattgcacatgtaacactttgtccagcagaattctctggaactgaaagatgtataatggaaccaagtaaaccagcaactgtaccatttctaactgtgaggagaaaacaagtggtgaaagttgtgcctcacaggtgctttgtgcaacaaattacaacaaaatttagaagcactaccatcct

SEQ ID NO: 72797 - DNA, 968 bp, Homo sapiens
ccagtggtcattcacctcttaaactttccactcttgcactgatcatcacctccacagcatatatctcacaaaatcttttcttatccaagtgtaaagacttattttttagcccagaacattattttttgttatttactttcccacaatgtttagatgagcatttatgtgaatgactgaatagatgcactgtgtcattatctaaacacgaaaacaggatcagtaacttttgttggatttgggcttactattgataaacactctagaatacacagttttaagcattgtctatgcaggtgattggcaatagttcgatgaatttatgaggaatgctgcagaaagagtctctgaattctctgattgaactcaggcctccttgatcccacaattaaaatgttagcataagcatgatattgtcatttttgcttaaattttattctcattttttatgtaaaattatattgtcttggagataggaaggatgagcaataatcctccatttaaatgtccataaaattataaatttaatcctgcaaaaccgactaaaaagtatttcatttgcattggatttttcctaccaccattccaaggataagtattatgctcatgttgaaaaaataaaataatttagttatttattgatttcttgtcatttatttcatgttgtcctgagattggatctaaactttgagctcctaatcattgctcagattgtgtggcctcgtaagattgtgcgtaataagtaaacaagcatctgtacacttgttaacttaatgagcttctgtatgtgacactttaagcctttttaaaaattaagtgctgggctatgcttggtgtctcatgcctgtaatctaagcactttgggaggctgaggaaggaggttcgctggaacccaggcatttgaaaccagcctgggcagcatagagacctcatctctttaaaaaaatttttaaaatagtaattatatgaaa

SEQ ID NO: 72798 - DNA, 258 bp, Homo sapiens
ccccccgctgcaattgaatcagcatcccatgtaacctgcccagaaaataggagtggaaatgagctgggtagccaccccgagcctctgccattaacttcatttacacattgttctcactcagccactcacaggaaggcatctttatgaaagcactgcaaacactatgtgtgaaaaaatccagatggtataaatagcttttcacttctaattgcaacttgcccctcacattttgtttcctgagagctctgaaaagagacc

SEQ ID NO: 72799 - DNA, 620 bp, Homo sapiens
aaatatatgagtttattataactgatgggtttccctctgaaattatagtgcaacattggttaactatttcctcaaacagattttttttaaaattaagttttacatcaacaggaagagcatattggttttggatgactgactgaattttaatgaatctacagtctttacttgaagtttaggtgttttcagggaagttctgtcttcaccttcttcctggaaacccagatttttattagacatggatttttagatgtaagaaaatattaatttaatttcatcatgttaaggactacttttctatgcatgtgtaaactgcttcaagcacttaacaggcttcttttttgttttatgatacgataattaatatattaagcatgctttgaaatgcattttaagatagaaaaggttaatcttttaaggaataacatagacaacttattgctagtattgtattgactggatccattctgattttttattgttattgaataatcaggcaagagctctgtagatttttttttgcctttaagaaaaaaatttcagtggaatggaattaacaaacataggtagccttttttattttttgggagatagggtctcactctgtcatctacactgga

SEQ ID NO: 72800 - DNA, 601 bp, Homo sapiens
ttttttacagcagattacacaaataccagttgaacttgtaaaagataagagtgctttcatatgaggatgacatattgtggtgaaattaaatgtgttcatgtagcttaacatcaggtttcatattgttacttatgagttaatagtcatggtgcatttggaacaaattattgaaaatatctccaagtttaaatagacaaatcaagatatgaaattaacctttctaaacttaagagggtaaaaagaaatcacttggccaatcacaactagcgcgcgtctttttaaaacgttgatcaaagccagtttcagcgccaacatttaaaaaaaaattaagacacgtcatcctagtagctagacacaattttgccaaggaaaaccaaagtacgttttaaataaaagctagaaacatggcacagaggggaaagggttgaaaacaccagcagttaaagatggacggaggaaagttttaatatttggtctacatgcaggagatgttctgtcagggagtgggcgtctccaccaatcgagctgcaggggaaaggctgccttgtccaatcagaacaggggtgtctttatatatacgggtacgaaaggctagactttc

SEQ ID NO: 72801 - DNA, 1084 bp, Homo sapiens
  misc_feature (752)..(754): n is a, c, g, or t
ccacctttaagtgaagcctcatggtctgtgatgttttcctaccaagagagggcaatagagcagaaaacttgcaggactagaaaagatgtgggttctggttccagctttgccacatggaggggcaactgaggaccagccacttaaaacttcccagggcctcaggtttcctcacttaatccccataataacctacaattttgagttcccaggcaaacctgaaattacatcatattcattatctgttgttacactttatcctgcccccaaaatcttaatgaaattgtgtaaggaataaaaacaaattggtggttgaaatgctaggtaaatgcaaaaagaataaagatatgatccagaacagtaaatgtttatagactgcttataaaaaagttaattcactcatcttgacaatggcaatgataacacatgtgcttcttaccacctggggatactgggtgaatgaaggcatctgaagactataaagtacaagacagatgtgggtggaattagatgagagcctggtctggctttctcagttctgattacatttcttccctgatgactcacttacaagttagtgaactccttgtttaagtattacaaactgcacaccttctcccttctcaatctagcttcacatcaggccttcctgccaaagcggcaaacttgccacatggggcaaggtactccccaagcagacaaggcccatctgtgtcatgagtgatacccaatgctaatgccatgctctgaaatgnnntgcccaccttggcttcccaaagtgctgggattgcagacgtgagtcactgcgcccagccattccatgtctcttaagtctcagaatctcccctagctccctccaggtgtctgcagtggttgtcccctcaaagctgtcccacaccctcctccgaggaccctttgtgtatctcctccagctaccgcagagcccacaaacccaggcatctatcaaagtccctcattcatgagggtggtgaggacacagactgcgaccagaacagaaatatgaaaatgtgaatgacagcgtcccccgtgtgtggaatgtggggattaaaagcatttatcaacctct

SEQ ID NO: 72802 - DNA, 604 bp, Homo sapiens
  misc_feature (594)..(594): n is a, c, g, or t
  misc_feature (598)..(598): n is a, c, g, or t
ctgaaaagagagcttattgtacctcacgcacagcagcaggtttaacagaaaagtagacatgtttatagtcccagatttacagcacaccttataaacaccttattacttagaatccagtctgctgtcccagaaactaagaatgtgactttgttaagcagtaggatttgttgacataaatgtcttgactaagtttgccattgtggttaaccaaaacgcatttactcctgggaaagtaaacacaagcaaacaaaatgcctcttatactacaatacggttgcaaagtccaagatcaagggactggaatcttatgagggccttctgctatgagagtcacatggcagaagggcaagagaagacaagagagaatgcaagaggaggaaaaactcatccttttatgatggcactaattccactcatgagggtgtagccctaatggcctcatcacctcttaaaggacctacttcttacttctgttacactgacaaattgcaacatgagttttggaaaggacaaacattcaaaccatagaattatgctcctgcccacccccacctaaactcatgtcctcacacacaaaatacattcgttgcttcncagnaaaaaa

SEQ ID NO: 72803 - DNA, 250 bp, Homo sapiens
tggcatgcgcctgcaatcccagctactcaggaggctgaggcaggagaattgcttgaacccaggaggagggagaattgcttgaaccctgggcgacagagcgagactccatctcaaaaacaaaacaaaacaaaaccaaaaactaaaatgtcagcagggccacgctccctcctaaggcttcagggagaatcattttttgcctcctccagcttctagtaggtccaggtgtccttggcttatggcctcatcactc

SEQ ID NO: 72804 - DNA, 328 bp, Homo sapiens
gtttgaggtggagtctcgctccgtcgcccaggctggagtgcagtggcacaatctcggctcactgcaagctccgcctcccgggttcacgccattctcctgcccaggaggtggaggttgtggtaagctgagatcatgccattgtgctccagcctgggcaacaagagcgaaactccatctcaaaagaaaaaaaaaaaagaataaatatagtaaagcgtgtgaactttgaagccaggctacttggacatgatccagtttgatccagccattcactagctgggtgacttttgacaagtgacataacatctctgaggctctacttcctctctgt

SEQ ID NO: 72805 - DNA, 802 bp, Homo sapiens
tagggcattaccaatttgggacggatctgtagtgtgagagattgttgtcactcttagctccaaacataggttgactttatatattatttacatgttcagaattatactgtgtagaaattcaaatgaaacttgcaaaatacttttctggcaggaagccctggagaggatcgttcatggaaacaaggatgacgactggggtaagaaatgcaggtgactcgtgagtggtcagggagtggaagagaagacggctggaaggttttagcattcagaaaaaaaatggagacaactagagttgatctgaagattatggcagaattcaatattgggggaaagaaacaagatgggggttagaaattagaaacagcagagctcccacaggttggaaaggttggaaaggatttgagcaagagaacaagaaggagcctgctaatagcaccctgggtttacatcaagagaagcacctggagagaattaactcgggaggaggtgggggcatgggaaaccttttcatctccaagagcgggcaggaacagcagctggcctgaacttgaaggtacaccaggtagcttgcgtgggccaggagaaggtgattctcttctatgcctctctccaacgccctgcttctgatgctgctcctctacctgtattgaggggaagatacatccctaagaagttccctgaaccccattctttgttgtggctaactggtccccttggaatttttctactaattttcaattccccctctcacctggtgaaatcttgaatcttactgttcaataaaagttcttctaccgaaatt

SEQ ID NO: 72806 - DNA, 1593 bp, Homo sapiens
  misc_feature (1161)..(1161): n is a, c, g, or t
ctgcagggacgagcgtgagttttgtaccgcggttaccacctactttccagctccaggtcttagtctaagagggagtgtctgctcatgaagaggcaaagccccaggagctgcgaaaagccttgcatggcccatctgagagatgtgctgagtcggcttgttaaaaatgacaggcaaagcctgtggggtggggcagctttcttggcctgagcgcatcttggttgagccagaggtgacttggggtggggagtggggcgccggttggtgggttctccctttaatttctcaaaggctgtggtgtttatgagtctgttggaatcctggttgggttggaatgaaggaaggttctagaaccattgtgggaagctcgctagtaaagatggtttggagatcggaagttgactgactttcccccattgaaaaatgtcacctgagattttagtgcctgtatcacgattataggctcaactttcttttccttgttttctttgatttagttctccttatgtgcaaaattactgtgtgatgttggctagtcgtattatcacagccactccgtgttttcaggatttgtagctggaagtcctatagcacttaagtcttcacttacagatcagcgcttgcttttattctgttttgtgtgatttctgctgttttcctgtgagttggtgttttcttcccaagtaggctcaggactcctctagggcaggacattatatgcatgtacatagtgtcctccagtgtaggggaggagaaggaggagaggtgaggtgggaaaagggtgagggaaggcttggatatttgaagttatttacaaatgagcttagacgtaaatccagttaacagatgacaccacaaattaatgattaaagaaatcctgaaattattttgtaaattacacacttatattgctgcattttttttctgttgaaagcattacttttaacagaaatggaaacattggaaataaaccatgtttttctcaccttttatgtcttcatctcttaatgtaccagtccctagagaagctgaagcccaatcctgtgtcctccaccccagccacccagccccatggtgaggacacagggagcttaggatagtactgctgcgtgcagcatacacctttgtctcattgacgtgcagagactgaccagatagagaagnttttttgatggaaaactcactgtggtgtctgcctggttgatcttgaatgatggcaagtgggcacttttcaggtaactattgatgattaactgacaaagatctgtgaaggctacactttgtcacttcagagtgccagagatacccatcagtaatatttttacatatatgcttagtaccatgcaggtaaatcccaggtgattgtcatcgagctgaacttttactcagatgtttaaagtgatgcacttgtaaggttataaggtgaaaatgctaatgtttaaagctatttggcattttaatttgacagttgttttataaatgaaccaaaaagaaagaagttgctgttttgcaataaatcagtgtgacacaaatcatatttcttaatatttcaagtgactgcttgccaactgcctgatggaatggcaccgtgaattc

SEQ ID NO: 72807 - DNA, 307 bp, Homo sapiens
acatccacagaaacttctgccagcgtgtgatgagctttcagggtgctggctccattcagctgctttcagtcctgtaccgagaaaaacattctgtgttaaagacgatggtgtcagctgctgaattgcttctgtaagtcctttaaaactcaaaaacccaatctatgtagattcatgttaaaatttccacatcagagttaacgtacaggatgtgcttgaataactttaccaacgtgaattttacttatattcttaaatgttatgctgttatattttattttgaagacattaaatggaacttcagatttag

SEQ ID NO: 72808 - DNA, 418 bp, Homo sapiens
ccaccacccccggctaatgttttccatttttatttcttatttattttttttgagacgtcgtcttgctctgtcgcccaggctagagtgcaatggcatgatctcagctcactgcaacatccgcctcccgggttcatgcgattctcctgcatcagcctcccgagtagctgggagctctagcctgagagacagagcaagattccatctcaaaaaataaataaatcttcgcgttagataaagggtttacttgtaaactggtaatttgttgcttttctgtgttaatctctaggtaaagtagcgacttccctctcctatttacgcatgcgctattactgtatttctactgagcgatgactttctctgcgtttctcatgtagcattgcactccagcctgggcaacaagggcgaagttctctcaaaa

SEQ ID NO: 72809 - DNA, 704 bp, Homo sapiens
cccccgggatgaagtgacccagcagaaataccagagaccggagacggaatggcccagggtcagcctccacccggaaccggaggatgcagcgaagacgtctccttgaagtgggatacggatgtgaaccggcccaagtgctcgccggtccgtcaagacgcgctgcccggctgctcccgtgtccaactcgggctgtgtccgcccaggcgggcctgtgcgcggaggtcctaccgctgcacctccgcgcctaccgcagcccgcacccccgcacccgggcagccaacgtgcaggaggcccgggcgccttcagcggagacgccccgaccgcggctgcctcgccgcagcgttagcttttacctacgtggggaagtaaggggaatttgcgaccgccagcccagtccgctgaaaacctgtggctgacccaccctcttcctttttctgacccacgttggctccaaaaaaaaaaatccctagggatccactgggagccagttgagcaggagtggattaagacacgtgtcgcagggtgtatggtggaaagaaacgttttcctttgctagaatgaaccttgggaaggatcccttttgattccgtagatgtaagaggctacacaatattatggaagaaggatgtaaaaaaaatgtattattattttttagttaccaactggactgaagtaaaagaccttttaaacttaaaaaaaaaaaa

SEQ ID NO: 72810 - DNA, 906 bp, Homo sapiens
  misc_feature (886)..(886): n is a, c, g, or t
  misc_feature (896)..(896): n is a, c, g, or t
cacgcgtcgggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgctcacggctgaagtgcgcaataaaagatgntttagggtcnctgcaaaaaa

SEQ ID NO: 72811 - DNA, 872 bp, Homo sapiens
  misc_feature (852)..(852): n is a, c, g, or t
  misc_feature (862)..(862): n is a, c, g, or t
cacgcgtcgggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggaggtgcaggccaagaagaaagccaacctacaatactacgcctagggcacacaggccagccccagtctcacggctgaagtgcgcaataaaagatgntttagggtcnctgcaaaaaa

SEQ ID NO: 72812 - DNA, 1364 bp, Homo sapiens
  misc_feature (1129)..(1129): n is a, c, g, or t
  misc_feature (1344)..(1344): n is a, c, g, or t
  misc_feature (1354)..(1354): n is a, c, g, or t
cacgcgtcgggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtaattgcagccacaaacagggtggacatcctggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccngctgcacagatgacttcaatggggcccagtgcaaggctgtgtgtgtggaggcgggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatgntttagggtcnctgcaaaaaa

SEQ ID NO: 72813 - DNA, 1312 bp, Homo sapiens
  misc_feature (1077)..(1077): n is a, c, g, or t
  misc_feature (1292)..(1292): n is a, c, g, or t
  misc_feature (1302)..(1302): n is a, c, g, or t
cacgcgtcgggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaagatggtgccaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtaattgcagccacaaacagggtggacatcctggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccngctgcacagatgacttcaatggggcccagtgcaaggctgtgtgtgtggaggcgggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatgntttagggtcnctgcaaaaaa

SEQ ID NO: 72814 - DNA, 3682 bp, Homo sapiens
  misc_feature (18)..(18): n is a, c, g, or t
  misc_feature (24)..(24): n is a, c, g, or t
  misc_feature (33)..(33): n is a, c, g, or t
cgtagaggggcacagcantgtctngagtcgagnagaggtggcggcgccgcagccatggagggaggcggcggcggcggcggcggcggctcgggtggctgcgctgggaggcggcggtgagaggctcgcacgcctccagcccggccccggccccccgggagggagagccgagcagccccggctctgggctacggactatgggcgaatagctctgaccacccggcgaagagctgagaatgaagcggagagcatcagacagaggagctggggaaacgtcggccagggccaaggctctaggaagtgggatttctggaaataatgcaaagagagctggaccattcatccttggtccccgtctgggcaactcaccggtgccaagcatagtgcagtgtttggcgaggaaagatggcacggatgacttctatcagctgaagatcctgaccctggaggagaggggggaccaaggcatagagagccaggaagagcggcagggcaagatgctgctgcacaccgagtactcactgctgtctctcctgcacacgcaggatggcgtggtgcaccaccacggcctcttccaggaccgcacctgtgaaatcgttgaggacacagaatccagccggatggttaagaagatgaagaagcgcatctgcctcgtcctggactgcctctgtgctcatgacttcagcgataagaccgctgacctcatcaacctgcagcactacgtcatcaaggagaagaggctcagcgagagggagactgtggtaatcttctacgacgtggtccgcgtggtggaggccctgcaccagaaaaatatcgtgcacagagacctgaagctggggaacatggtgctcaacaagaggacacatcggataaccatcaccaacttctgcctcgggaagcatctggtgagcgagggggacctgctgaaggaccagagagggagccctgcctacatcagtcccgacgtgctcagcggccggccgtaccgtggcaagcccagtgacatgtgggccctgggcgtggtgctcttcaccatgctgtatggccagttccccttctacgacagcatcccgcaggagctcttccgcaagatcaaggctgccgagtataccattcctgaggatggacgggtttctgagaacaccgtgtgtctcatccggaagctgctggtccttgacccccagcagcgcctggccgccgccgacgtcctggaggccctcagtgccatcattgcatcatggcagtccctgtcatctctgagtgggcctttgcaagtggttcctgacattgatgaccaaatgagcaatgcggatagctcccaggaggcgaaggtgacggaggagtgctcccagtacgagtttgagaactacatgcgtcagcagctgctgctggccgaggagaagagctccatccatgacgcccggagctgggtacccaagcggcagttcggcagcgcaccaccggtgcgacggctgggccacgacgcacagcccatgacctccttggacacggccatcctggcgcagcgctacctgcggaaataacagcctcagccggggccaccagcactgctgccacttcttccagccccagccaaaggcgtggctgtcagggctgggccctgtagtgctggactctcccgggccacaatagggacagggcagggacagggacagcccaggtcacacgtggggtcagcagaggtaccacgaagctaccttttgggatgattgctcgattgtttggtttttaaatctgagaagcctagataactaatctgcttttaatcacgatgttttaatctacctctgtctctttaaccatgctgtctctggactgagcaagagggaggagggagcctgctcaccccactccagggccttccccagcggccaccaactgacctggggcgctgctccccacagtccaaataagctgaaagtgcagctcgctgcaggccccagagcgagcttcccctcctccctgctctcccaggcccctgccacagcctctttccgtccctctctttctgatccaggcccctcagtccaagctttggaaaaccttcacctcatcttaaaccgaactcaaatatatttatttttttaccataccaacttctctcccatctctaggtggctcagtccatggccactccctgcccccagcctggctggacagcaaggaatccacagcccacacgtgagctccctcctcacccccaggcagggaagcccctcctgccagtccctgtcccctttcagcccaccagtccctctctgctgccggtgatgggaggcctttctagacctggctctttctctcccgtctcagtggcttctctgaggtgctgtacacgcgcgttaacctgttcccttctctatccttccccgtggtactgagctcacgtggactcccagtgcgaaggggcccatgggttgggctgcaggcctggccgtgagcgggggctgcctgcacgctcccctagcctactcttgtgtttaggggatggtgggaacatatcccagtgcccttgcctcataatagatgtggtgactctcccggtagaccctagcaagggtcctccatggtggtgagggactcaggagaattgtagggattgggggaccctgcctgcctggcttgagaacagccctgctgcccttttgagccgagattttgaagtggatgcccgtcttgccagaaatgctgttctcaccagaatgccccctccccttgcccttactggacttggccctgcctgatgccaagcaaagacccttccccagaggcctaccccccatatgtcctcagagaggctgagtgtcccctccaggcagtcatgggccctgaggcccctcctgcctggccctgctccccagtggggaggtgactgtgtttcccagagtgtgagccgctctcctccccctaaaaagctgactcactgtgagtgaccttgggcaagttcccaaacctccttgtgcctcagtttccccatctggaaaaaatggggccacctcttgccagcagtagcagggctgcccacgcccctttctccccatgccccatccagcacttgggcgactcatgcctctgcctcagtgggcctgtgggagcctactggagcccagcacttactccccctgagcagcgagcctgcgtctgtctcagctgtccagcgctgagggccagggtcttgtgctgtggggctgggggatgccctcttttctatatttatttcatagaaagtctcctgcgggagcggaaatgcagtccggcctagggctcccagcccttgactgtcctcctgtgagggcctgaagctgggccagggcccgtcgcagcggagccccctctcagcagcccaccgggtccctccaggctgctgcccgtgcgtggtctttctcctccttttcaaagcaatagccgccgggtctgcaaagccctgtcagacagactgggcccttccaaggtcaagccatgtgtctgatgacattcctggtgaagcaaaggagaggaggatgggtcagccctcactgggtgtcacacactgagagaagtcctattgtaaagaaacggaaaaagtcacaaaaaagtttgtataaagacatatttttgtactacatggggactcttcctgcatgtcagcaataaaacttcctgatctggaaccactgtggaaaaa

SEQ ID NO: 72815 - DNA, 3921 bp, Homo sapiens
  misc_feature (2068)..(2068): n is a, c, g, or t
  misc_feature (2207)..(2207): n is a, c, g, or t
  misc_feature (2230)..(2230): n is a, c, g, or t
  misc_feature (2377)..(2377): n is a, c, g, or t
  misc_feature (2956)..(2956): n is a, c, g, or t
ataaatccccctttttgtgtctcagggcagacagaggttctggctgccttttacttgagtcatgggcgctccagagtggcagggtagtgtggtacagagagactcactgctccgtgtgtgtcctctggcacaccctccgctctggggccccactctcacctcgttcagttgacctgaaggagctccagcccactccagccccttcccacccatcatgccaggctataactccactggagcagtaggcggaccagctggaggccttctcagcagagcagagagctctcaaggagcagacagggggaggtgttggcaaggcagctgcaacaacaagttcaccccgctttggattttaaaaggatcgaaattcgaaatcctcttctggggttatgtgaggtgctgtggggtctttttccttcctcctttctttttggtaggcaagcaacataccaagttcctagaaaaggagaaaaacactgtggcagcccagagggccatagctaaagcgtgactcactcagagccgatcctactgacacacgtcccctccctccgtcccactctgccattgccccctcctgtcaggaccagactagggggtctgggactcccggggagccatgcaccccccacttgggtggtggtggcagggcaggggagtgttgccaaacctcaggaggacttggagctgcccgtgccacttcctgtggagagactccagtgcgcctgccgctcagccctgcagagcctcagctgtgcctgcccgtgccctggcagagggtgggaaagtcccaccagcagtgttgagttgaaagctcagccacactggcatgtgctctccggggcctgttgtcacaccatggcacctctcccctaccgcctccaagacagagtcttttcctaccaggtgtgccaaccatcggagatgagaggacaccagcttctactatttgccaggcattgggctaagtgccctccatgagattatcttatcttgctgaatcctaacccagttctggagtttggtgctgggatttcactgttgtacgcatgaggaaattgaggtttagcaagagattcacagagcaaggaagtggcagagccaggactaggaacctggctcccaaacccaccgtactttctcctgagctgtcctcctctcagcgtcttgagcctcagagacccacaggatgcatttgcagcttccgcggccatctctgaccaggggagaaaacccacagtgcctctgctctgtgggaaccttctggacaagaggcccgagcagccccatattcagggcagcggcactggagcttcagagctagagcagcccactccttgacgtgcaagtgaccctttgcagtgacccttcacctgtgcgatcaggctctagccgcctgcgggccaccagtcagactcctatggcagctgacagggcggacctgtataggcgctggagttggcgtttccgtggggaatccagaggacgggctggcctttgttttgcatcgagccctttgccagcagaattccccgagatcaccgagggctctcagagccgcctggatgcggctcccggggaaatccgccagcagccacacatgccctctgcctctgagagctgattgtagggagaggcagcccaaggcccccatggagctctccttcctgttgtcctcccagcttctccccctagcttctccacccagccagccgacacaggagcagggcagttgggtagagaggcatccttcctcactgcctgccccagtgggccaggaaacctttcccaggcctcttagacagggcctgcccaccctcccagcccccagtgtggtgtaaggtgtaagggtcctctcggggcacttccttttgtccacatgtgagttttctccaaaggatcagagcccaaagctgccctgccccacgcctttcagagggagggtctgtgatgttctagccagggcagagtcacaagtacgaggtaagggatgagtcagctttgatggaacagaaggaaaagtcattcggggcctggggccctgcccagggacacatctgggcatgangcagctgtcagttgtgtgtgcagctctggggccctgcagacctggtcttggatcctgctcttctgctcaccagctgcatgaccttggccaagtcctttcacttccctgtgcctttgttgtatcatctgaaacaggaccntgagaaaatccccctcattggcnactgtcagtttcttcctctgcagtggttgtggggccaagtgagaactgacatattccgtggttcggaggtggctcggggccagcccttgggtcaccttccaaggtggagtcactcacctctgctggacttccttttcctcatgtgtnaatgaggaaattgaactaaatctcaggtcactcccagtctagaatattacgtgaggctgtttttgagaaatctctgaaagttgttctaagccctaagctgtaccccgagattcagcccgggcagcaggtccagggatggcctgtgcaacactcagatacctgggagagaagccgatccctgctgggacagctcggctggtggccagaaaagtctggggcctgattcctctgctctgctccctggagagggggtcggggcagctgcttcaccctctgacgagaagcctacctcctactgttcaggattgggtgttggcccagtgaggtgtgtcctgcctgcgtgtcttgtgcctgttgctatagacactgaggtttgttcactctgtctcccactcctaggacacatcggataaccatcaccaacttctgcctcgggaagcatctggtgagcgagggggacctgctgaaggaccagagagggagccctgcctacatcagtcccgacgtgctcagcggtacgtgtgtgtgccagacattgggcctctaagctcaatacagccaggctctgtgacagtccantcagcaaatttgtgggcaggccctgggcaaggtgctggggcttcactgggggcccagaccagtactgtccctccccatacaaaatgtttggtctgttggaggtggaagacgtaatgataacatgaatgcatgtttaattcctctgaggttagtgctagggaggaacgggattgctgtgagagtggatgaagggtgcttggaggactttccccacaaggtgtgacagttgagctatgatcttaagggaaactaggaattccctgggtatgtgtgactaggctgaggctgagggtcccagaggcagcacagcacgttggagcaattgcaggctgctcagaaagtgagcctggttcaaggggaagccagagaggtgcgcaggggccagatcaggcaaggcctgacataggcctcagtaagagatgtcatcctttacttcaagtgcgagtggaagccattgaacagttcttaactgagtgtgctgctgtgagtttgtgtttcagagccctctctccttgtctgtgttcattcattctgttactgtttgctgagggccacccaggcccaaagctctgttctagacactttggagacaacagggaacaaagtagacaaacattgctgccttcatggagctgactttctagtggggatgagacagataatacacgaaacaaataagtaactcacaggccgggtgcagtggctcatgcctgtaatcccaacactttgggaggctgtggcgggatcataaggtcaggagttcgagaccagcctggccaatatggtgaaaccctgtctctactaaaaatacagaaattagccgggcgtggtggcggttgcctgtaatccaagctactcgggaggctaaggcaggagaatcgcttgaacccaggaggtggaggttgcagtgagccgagattgtgccactgcactccagcctgggcaacagggcgagactccatctc

SEQ ID NO: 72816 - DNA, 5072 bp, Homo sapiens
  misc_feature (18)..(18): n is a, c, g, or t
  misc_feature (24)..(24): n is a, c, g, or t
  misc_feature (33)..(33): n is a, c, g, or t
cgtagaggggcacagcantgtctngagtcgagnagaggtggcggcgccgcagccatggagggaggcggcggcggcggcggcggcggctcgggtggctgcgctgggaggcggcggtgagaggctcgcacgcctccagcccggccccggccccccgggagggagagccgagcagccccggctctgggctacggactatgggcgaatagctctgaccacccggcgaagagctgagaatgaagcggagagcatcagacagaggagctggggaaacgtcggccagggccaaggctctaggaagtgggatttctggaaataatgcaaagagagctggaccattcatccttggtccccgtctgggcaactcaccggtgccaagcatagtgcagtgtttggcgaggaaagatggcacggatgacttctatcagctgaagatcctgaccctggaggagaggggggaccaaggcatagagagccaggaagagcggcagggcaagatgctgctgcacaccgagtactcactgctgtctctcctgcacacgcaggatggcgtggtgcaccaccacggcctcttccaggaccgcacctgtgaaatcgttgaggacacagaatccagccggatggttaagaagatgaagaagcgcatctgcctcgtcctggactgcctctgtgctcatgacttcagcgataagaccgctgacctcatcaacctgcagcactacgtcatcaaggagaagaggctcagcgagagggagactgtggtaatcttctacgacgtggtccgcgtggtggaggccctgcaccagaaaaatatcgtgcacagagacctgaagctggggaacatggtgctcaacaagaggacacatcggataaccatcaccaacttctgcctcgggaagcatctggtgagcgagggggacctgctgaaggaccagagagggagccctgcctacatcagtcccgacgtgctcagcggccggccgtaccgtggcaagcccagtgacatgtgggccctgggcgtggtgctcttcaccatgctgtatggccagttccccttctacgacagcatcccgcaggagctcttccgcaagatcaaggctgccgagtataccattcctgaggatggacgggtttctgagaacaccgtgtgtctcatccggaagctgctggtccttgacccccagcagcgcctggccgccgccgacgtcctggaggccctcagtgccatcattgcatcatggcagtccctgtcatctctgagtgggcctttgcaagtggttcctgacattgatgaccaaatgagcaatgcggatagctcccaggaggtgagttggggagggcagatgggccattacccagccccaagggacaggcttctgggggcaggcagggcaagggcagaggtggcagctacccgcaggccacagagtttccttggtcttcttccccagccttggggtgggaaagggagacttcagtcctcagcctgagctgcctggggcctgccttgggcttggtgtagctggagatctttggccagagagacctgtgagacagccgagctggagccagtgcccaagtggcccaggccagccctctcagcttcctcctgctgcccaagtcacatttctctgccccctgactcagagttctctctcacccttcctgcttttcatttttcagatgattcatttctccctatttctttcctccccattccctgcactggagaaagtgttgggcctagggtgggggcagagacttgggcaccaggcagcagagggcaggtgatcttagggtgccccctggagggcagggcttggccgagcaacagcattgctgggccctggatattggaaggaccttccctccctggcccaccttggagctccacagtgagcagtgtgcaggtaggaccaggaggggccgtgcctgggagagcctcccagagcctcctggcccccgaggaaagagagttccaatccctacccacctccagcttccaccctttagctgtttggctaaaatcatcatcactagcccgcagtgagtgcctaccccgagggcacctcattcagccctcactgcgggcctgcgtggcctgtgttcttagccccatgttacagaagaggaaacagggttagagaggactttcccaaagccacacagcttagaagtagtggagctaagccttgaacccaagtctcatccggaagccctgctgtctcctgtggtgactggcacggggacaccacttcagcttctgttaccatctgcctagaccatcccagggagctcagcatggggccctgcgtatgtggctcctccaggtgctgcgcccccagcccagggcttgctcgtacctcttgacgtgcattagccgcctcagggctcagagaacctttgcgaggggccagacagctaaggcttctgaggtaaagtgacctctcacgcagccagtgagttaggaagcatgagtctgcgtcagtcccgggtccgcagggcggcctgcaaggggagttgaggttggctggagggggtcagggacccaccctcagcgccactcccacccccggccttgaggcctgagggtgtggtgcctggaagggtgactgcaggagccaggctgccagcactcttgcctgccctcctgtctgctgcgctgccttcatctgggtttatctttgtctccttcccaccctccccgcctcaaaggcgaaggtgacggaggagtgctcccagtacgagtttgagaactacatgcgtcagcagctgctgctggccgaggagaagagctccatccatgacgcccggagctgggtacccaagcggcagttcggcagcgcaccaccggtgcgacggctgggccacgacgcacagcccatgacctccttggacacggccatcctggcgcagcgctacctgcggaaataacagcctcagccggggccaccagcactgctgccacttcttccagccccagccaaaggcgtggctgtcagggctgggccctgtagtgctggactctcccgggccacaatagggacagggcagggacagggacagcccaggtcacacgtggggtcagcagaggtaccacgaagctaccttttgggatgattgctcgattgtttggtttttaaatctgagaagcctagataactaatctgcttttaatcacgatgttttaatctacctctgtctctttaaccatgctgtctctggactgagcaagagggaggagggagcctgctcaccccactccagggccttccccagcggccaccaactgacctggggcgctgctccccacagtccaaataagctgaaagtgcagctcgctgcaggccccagagcgagcttcccctcctccctgctctcccaggcccctgccacagcctctttccgtccctctctttctgatccaggcccctcagtccaagctttggaaaaccttcacctcatcttaaaccgaactcaaatatatttatttttttaccataccaacttctctcccatctctaggtggctcagtccatggccactccctgcccccagcctggctggacagcaaggaatccacagcccacacgtgagctccctcctcacccccaggcagggaagcccctcctgccagtccctgtcccctttcagcccaccagtccctctctgctgccggtgatgggaggcctttctagacctggctctttctctcccgtctcagtggcttctctgaggtgctgtacacgcgcgttaacctgttcccttctctatccttccccgtggtactgagctcacgtggactcccagtgcgaaggggcccatgggttgggctgcaggcctggccgtgagcgggggctgcctgcacgctcccctagcctactcttgtgtttaggggatggtgggaacatatcccagtgcccttgcctcataatagatgtggtgactctcccggtagaccctagcaagggtcctccatggtggtgagggactcaggagaattgtagggattgggggaccctgcctgcctggcttgagaacagccctgctgcccttttgagccgagattttgaagtggatgcccgtcttgccagaaatgctgttctcaccagaatgccccctccccttgcccttactggacttggccctgcctgatgccaagcaaagacccttccccagaggcctaccccccatatgtcctcagagaggctgagtgtcccctccaggcagtcatgggccctgaggcccctcctgcctggccctgctccccagtggggaggtgactgtgtttcccagagtgtgagccgctctcctccccctaaaaagctgactcactgtgagtgaccttgggcaagttcccaaacctccttgtgcctcagtttccccatctggaaaaaatggggccacctcttgccagcagtagcagggctgcccacgcccctttctccccatgccccatccagcacttgggcgactcatgcctctgcctcagtgggcctgtgggagcctactggagcccagcacttactccccctgagcagcgagcctgcgtctgtctcagctgtccagcgctgagggccagggtcttgtgctgtggggctgggggatgccctcttttctatatttatttcatagaaagtctcctgcgggagcggaaatgcagtccggcctagggctcccagcccttgactgtcctcctgtgagggcctgaagctgggccagggcccgtcgcagcggagccccctctcagcagcccaccgggtccctccaggctgctgcccgtgcgtggtctttctcctccttttcaaagcaatagccgccgggtctgcaaagccctgtcagacagactgggcccttccaaggtcaagccatgtgtctgatgacattcctggtgaagcaaaggagaggaggatgggtcagccctcactgggtgtcacacactgagagaagtcctattgtaaagaaacggaaaaagtcacaaaaaagtttgtataaagacatatttttgtactacatggggactcttcctgcatgtcagcaataaaacttcctgatctggaaccactgtggaaaaa

SEQ ID NO: 72817 - DNA, 3560 bp, Homo sapiens
tcagaagggtggtgataccaacttactattggaggcagtgggcagcgcaggacaggcccagggccgccgaccctggcaatgactgtcaccagctggagggaagagctgagaatgaagcggagagcatcagacagaggagctggggaaacgtcggccagggccaaggctctaggaagtgggatttctggaaataatgcaaagagagctggaccattcatccttggtccccgtctgggcaactcaccggtgccaagcatagtgcagtgtttggcgaggaaagatggcacggatgacttctatcagctgaagatcctgaccctggaggagaggggggaccaaggcatagagagccaggaagagcggcagggcaagatgctgctgcacaccgagtactcactgctgtctctcctgcacacgcaggatggcgtggtgcaccaccacggcctcttccaggaccgcacctgtgaaatcgttgaggacacagaatccagccggatggttaagaagatgaagaagcgcatctgcctcgtcctggactgcctctgtgctcatgacttcagcgataagaccgctgacctcatcaacctgcagcactacgtcatcaaggagaagaggctcagcgagagggagactgtggtaatcttctacgacgtggtccgcgtggtggaggccctgcaccagaaaaatatcgtgcacagagacctgaagctggggaacatggtgctcaacaagaggacacatcggataaccatcaccaacttctgcctcgggaagcatctggtgagcgagggggacctgctgaaggaccagagagggagccctgcctacatcagtcccgacgtgctcagcggccggccgtaccgtggcaagcccagtgacatgtgggccctgggcgtggtgctcttcaccatgctgtatggccagttccccttctacgacagcatcccgcaggagctcttccgcaagatcaaggctgccgagtataccattcctgaggatggacgggtttctgagaacaccgtgtgtctcatccggaagctgctggtccttgacccccagcagcgcctggccgccgccgacgtcctggaggccctcagtgccatcattgcatcatggcagtccctgtcatctctgagtgggcctttgcaagtggttcctgacattgatgaccaaatgagcaatgcggatagctcccaggaggcgaaggtgacggaggagtgctcccagtacgagtttgagaactacatgcgtcagcagctgctgctggccgaggagaagagctccatccatgacgcccggagctgggtacccaagcggcagttcggcagcgcaccaccggtgcgacggctgggccacgacgcacagcccatgacctccttggacacggccatcctggcgcagcgctacctgcggaaataacagcctcagccggggccaccagcactgctgccacttcttccagccccagccaaaggcgtggctgtcagggctgggccctgtagtgctggactctcccgggccacaatagggacagggcagggacagggacagcccaggtcacacgtggggtcagcagaggtaccacgaagctaccttttgggatgattgctcgattgtttggtttttaaatctgagaagcctagataactaatctgcttttaatcacgatgttttaatctacctctgtctctttaaccatgctgtctctggactgagcaagagggaggagggagcctgctcaccccactccagggccttccccagcggccaccaactgacctggggcgctgctccccacagtccaaataagctgaaagtgcagctcgctgcaggccccagagcgagcttcccctcctccctgctctcccaggcccctgccacagcctctttccgtccctctctttctgatccaggcccctcagtccaagctttggaaaaccttcacctcatcttaaaccgaactcaaatatatttatttttttaccataccaacttctctcccatctctaggtggctcagtccatggccactccctgcccccagcctggctggacagcaaggaatccacagcccacacgtgagctccctcctcacccccaggcagggaagcccctcctgccagtccctgtcccctttcagcccaccagtccctctctgctgccggtgatgggaggcctttctagacctggctctttctctcccgtctcagtggcttctctgaggtgctgtacacgcgcgttaacctgttcccttctctatccttccccgtggtactgagctcacgtggactcccagtgcgaaggggcccatgggttgggctgcaggcctggccgtgagcgggggctgcctgcacgctcccctagcctactcttgtgtttaggggatggtgggaacatatcccagtgcccttgcctcataatagatgtggtgactctcccggtagaccctagcaagggtcctccatggtggtgagggactcaggagaattgtagggattgggggaccctgcctgcctggcttgagaacagccctgctgcccttttgagccgagattttgaagtggatgcccgtcttgccagaaatgctgttctcaccagaatgccccctccccttgcccttactggacttggccctgcctgatgccaagcaaagacccttccccagaggcctaccccccatatgtcctcagagaggctgagtgtcccctccaggcagtcatgggccctgaggcccctcctgcctggccctgctccccagtggggaggtgactgtgtttcccagagtgtgagccgctctcctccccctaaaaagctgactcactgtgagtgaccttgggcaagttcccaaacctccttgtgcctcagtttccccatctggaaaaaatggggccacctcttgccagcagtagcagggctgcccacgcccctttctccccatgccccatccagcacttgggcgactcatgcctctgcctcagtgggcctgtgggagcctactggagcccagcacttactccccctgagcagcgagcctgcgtctgtctcagctgtccagcgctgagggccagggtcttgtgctgtggggctgggggatgccctcttttctatatttatttcatagaaagtctcctgcgggagcggaaatgcagtccggcctagggctcccagcccttgactgtcctcctgtgagggcctgaagctgggccagggcccgtcgcagcggagccccctctcagcagcccaccgggtccctccaggctgctgcccgtgcgtggtctttctcctccttttcaaagcaatagccgccgggtctgcaaagccctgtcagacagactgggcccttccaaggtcaagccatgtgtctgatgacattcctggtgaagcaaaggagaggaggatgggtcagccctcactgggtgtcacacactgagagaagtcctattgtaaagaaacggaaaaagtcacaaaaaagtttgtataaagacatatttttgtactacatggggactcttcctgcatgtcagcaataaaacttcctgatctggaaccactgtggaaaaa

SEQ ID NO: 72818 - DNA, 3582 bp, Homo sapiens
gccagtacggcccacgagaaagagcttagaacatcagttacttttatatgaagaaaaatacaggaacaggctggagttctgtgtttttgagtccattatggaagggtaaaggctacactcctaagagctgagaatgaagcggagagcatcagacagaggagctggggaaacgtcggccagggccaaggctctaggaagtgggatttctggaaataatgcaaagagagctggaccattcatccttggtccccgtctgggcaactcaccggtgccaagcatagtgcagtgtttggcgaggaaagatggcacggatgacttctatcagctgaagatcctgaccctggaggagaggggggaccaaggcatagagagccaggaagagcggcagggcaagatgctgctgcacaccgagtactcactgctgtctctcctgcacacgcaggatggcgtggtgcaccaccacggcctcttccaggaccgcacctgtgaaatcgttgaggacacagaatccagccggatggttaagaagatgaagaagcgcatctgcctcgtcctggactgcctctgtgctcatgacttcagcgataagaccgctgacctcatcaacctgcagcactacgtcatcaaggagaagaggctcagcgagagggagactgtggtaatcttctacgacgtggtccgcgtggtggaggccctgcaccagaaaaatatcgtgcacagagacctgaagctggggaacatggtgctcaacaagaggacacatcggataaccatcaccaacttctgcctcgggaagcatctggtgagcgagggggacctgctgaaggaccagagagggagccctgcctacatcagtcccgacgtgctcagcggccggccgtaccgtggcaagcccagtgacatgtgggccctgggcgtggtgctcttcaccatgctgtatggccagttccccttctacgacagcatcccgcaggagctcttccgcaagatcaaggctgccgagtataccattcctgaggatggacgggtttctgagaacaccgtgtgtctcatccggaagctgctggtccttgacccccagcagcgcctggccgccgccgacgtcctggaggccctcagtgccatcattgcatcatggcagtccctgtcatctctgagtgggcctttgcaagtggttcctgacattgatgaccaaatgagcaatgcggatagctcccaggaggcgaaggtgacggaggagtgctcccagtacgagtttgagaactacatgcgtcagcagctgctgctggccgaggagaagagctccatccatgacgcccggagctgggtacccaagcggcagttcggcagcgcaccaccggtgcgacggctgggccacgacgcacagcccatgacctccttggacacggccatcctggcgcagcgctacctgcggaaataacagcctcagccggggccaccagcactgctgccacttcttccagccccagccaaaggcgtggctgtcagggctgggccctgtagtgctggactctcccgggccacaatagggacagggcagggacagggacagcccaggtcacacgtggggtcagcagaggtaccacgaagctaccttttgggatgattgctcgattgtttggtttttaaatctgagaagcctagataactaatctgcttttaatcacgatgttttaatctacctctgtctctttaaccatgctgtctctggactgagcaagagggaggagggagcctgctcaccccactccagggccttccccagcggccaccaactgacctggggcgctgctccccacagtccaaataagctgaaagtgcagctcgctgcaggccccagagcgagcttcccctcctccctgctctcccaggcccctgccacagcctctttccgtccctctctttctgatccaggcccctcagtccaagctttggaaaaccttcacctcatcttaaaccgaactcaaatatatttatttttttaccataccaacttctctcccatctctaggtggctcagtccatggccactccctgcccccagcctggctggacagcaaggaatccacagcccacacgtgagctccctcctcacccccaggcagggaagcccctcctgccagtccctgtcccctttcagcccaccagtccctctctgctgccggtgatgggaggcctttctagacctggctctttctctcccgtctcagtggcttctctgaggtgctgtacacgcgcgttaacctgttcccttctctatccttccccgtggtactgagctcacgtggactcccagtgcgaaggggcccatgggttgggctgcaggcctggccgtgagcgggggctgcctgcacgctcccctagcctactcttgtgtttaggggatggtgggaacatatcccagtgcccttgcctcataatagatgtggtgactctcccggtagaccctagcaagggtcctccatggtggtgagggactcaggagaattgtagggattgggggaccctgcctgcctggcttgagaacagccctgctgcccttttgagccgagattttgaagtggatgcccgtcttgccagaaatgctgttctcaccagaatgccccctccccttgcccttactggacttggccctgcctgatgccaagcaaagacccttccccagaggcctaccccccatatgtcctcagagaggctgagtgtcccctccaggcagtcatgggccctgaggcccctcctgcctggccctgctccccagtggggaggtgactgtgtttcccagagtgtgagccgctctcctccccctaaaaagctgactcactgtgagtgaccttgggcaagttcccaaacctccttgtgcctcagtttccccatctggaaaaaatggggccacctcttgccagcagtagcagggctgcccacgcccctttctccccatgccccatccagcacttgggcgactcatgcctctgcctcagtgggcctgtgggagcctactggagcccagcacttactccccctgagcagcgagcctgcgtctgtctcagctgtccagcgctgagggccagggtcttgtgctgtggggctgggggatgccctcttttctatatttatttcatagaaagtctcctgcgggagcggaaatgcagtccggcctagggctcccagcccttgactgtcctcctgtgagggcctgaagctgggccagggcccgtcgcagcggagccccctctcagcagcccaccgggtccctccaggctgctgcccgtgcgtggtctttctcctccttttcaaagcaatagccgccgggtctgcaaagccctgtcagacagactgggcccttccaaggtcaagccatgtgtctgatgacattcctggtgaagcaaaggagaggaggatgggtcagccctcactgggtgtcacacactgagagaagtcctattgtaaagaaacggaaaaagtcacaaaaaagtttgtataaagacatatttttgtactacatggggactcttcctgcatgtcagcaataaaacttcctgatctggaaccactgtggaaaaa

SEQ ID NO: 72819 - DNA, 3823 bp, Homo sapiens
agtactatctctctctgtctctgtggtatctcttggggcctgtatgcattagcatctgcacggagcccagttttctcctctctgaatgtaactggccacttggtggtggtgtgttagctccccgcctctgtaccctgtatatgctgccttacaggatgtccacctttagcatctaatttatccctagtcaaggagctgtggttgtttgtcacttggagccttggatgctcccctggtagctaggaggagttggaggcagcagcggcagctgtgtgatgcatcccaagtccacggcccgcaggctgggttagcataaggaaactcgctgacttactcagtgagaaggggtctttctgtcttgtctagagctgagaatgaagcggagagcatcagacagaggagctggggaaacgtcggccagggccaaggctctaggaagtgggatttctggaaataatgcaaagagagctggaccattcatccttggtccccgtctgggcaactcaccggtgccaagcatagtgcagtgtttggcgaggaaagatggcacggatgacttctatcagctgaagatcctgaccctggaggagaggggggaccaaggcatagagagccaggaagagcggcagggcaagatgctgctgcacaccgagtactcactgctgtctctcctgcacacgcaggatggcgtggtgcaccaccacggcctcttccaggaccgcacctgtgaaatcgttgaggacacagaatccagccggatggttaagaagatgaagaagcgcatctgcctcgtcctggactgcctctgtgctcatgacttcagcgataagaccgctgacctcatcaacctgcagcactacgtcatcaaggagaagaggctcagcgagagggagactgtggtaatcttctacgacgtggtccgcgtggtggaggccctgcaccagaaaaatatcgtgcacagagacctgaagctggggaacatggtgctcaacaagaggacacatcggataaccatcaccaacttctgcctcgggaagcatctggtgagcgagggggacctgctgaaggaccagagagggagccctgcctacatcagtcccgacgtgctcagcggccggccgtaccgtggcaagcccagtgacatgtgggccctgggcgtggtgctcttcaccatgctgtatggccagttccccttctacgacagcatcccgcaggagctcttccgcaagatcaaggctgccgagtataccattcctgaggatggacgggtttctgagaacaccgtgtgtctcatccggaagctgctggtccttgacccccagcagcgcctggccgccgccgacgtcctggaggccctcagtgccatcattgcatcatggcagtccctgtcatctctgagtgggcctttgcaagtggttcctgacattgatgaccaaatgagcaatgcggatagctcccaggaggcgaaggtgacggaggagtgctcccagtacgagtttgagaactacatgcgtcagcagctgctgctggccgaggagaagagctccatccatgacgcccggagctgggtacccaagcggcagttcggcagcgcaccaccggtgcgacggctgggccacgacgcacagcccatgacctccttggacacggccatcctggcgcagcgctacctgcggaaataacagcctcagccggggccaccagcactgctgccacttcttccagccccagccaaaggcgtggctgtcagggctgggccctgtagtgctggactctcccgggccacaatagggacagggcagggacagggacagcccaggtcacacgtggggtcagcagaggtaccacgaagctaccttttgggatgattgctcgattgtttggtttttaaatctgagaagcctagataactaatctgcttttaatcacgatgttttaatctacctctgtctctttaaccatgctgtctctggactgagcaagagggaggagggagcctgctcaccccactccagggccttccccagcggccaccaactgacctggggcgctgctccccacagtccaaataagctgaaagtgcagctcgctgcaggccccagagcgagcttcccctcctccctgctctcccaggcccctgccacagcctctttccgtccctctctttctgatccaggcccctcagtccaagctttggaaaaccttcacctcatcttaaaccgaactcaaatatatttatttttttaccataccaacttctctcccatctctaggtggctcagtccatggccactccctgcccccagcctggctggacagcaaggaatccacagcccacacgtgagctccctcctcacccccaggcagggaagcccctcctgccagtccctgtcccctttcagcccaccagtccctctctgctgccggtgatgggaggcctttctagacctggctctttctctcccgtctcagtggcttctctgaggtgctgtacacgcgcgttaacctgttcccttctctatccttccccgtggtactgagctcacgtggactcccagtgcgaaggggcccatgggttgggctgcaggcctggccgtgagcgggggctgcctgcacgctcccctagcctactcttgtgtttaggggatggtgggaacatatcccagtgcccttgcctcataatagatgtggtgactctcccggtagaccctagcaagggtcctccatggtggtgagggactcaggagaattgtagggattgggggaccctgcctgcctggcttgagaacagccctgctgcccttttgagccgagattttgaagtggatgcccgtcttgccagaaatgctgttctcaccagaatgccccctccccttgcccttactggacttggccctgcctgatgccaagcaaagacccttccccagaggcctaccccccatatgtcctcagagaggctgagtgtcccctccaggcagtcatgggccctgaggcccctcctgcctggccctgctccccagtggggaggtgactgtgtttcccagagtgtgagccgctctcctccccctaaaaagctgactcactgtgagtgaccttgggcaagttcccaaacctccttgtgcctcagtttccccatctggaaaaaatggggccacctcttgccagcagtagcagggctgcccacgcccctttctccccatgccccatccagcacttgggcgactcatgcctctgcctcagtgggcctgtgggagcctactggagcccagcacttactccccctgagcagcgagcctgcgtctgtctcagctgtccagcgctgagggccagggtcttgtgctgtggggctgggggatgccctcttttctatatttatttcatagaaagtctcctgcgggagcggaaatgcagtccggcctagggctcccagcccttgactgtcctcctgtgagggcctgaagctgggccagggcccgtcgcagcggagccccctctcagcagcccaccgggtccctccaggctgctgcccgtgcgtggtctttctcctccttttcaaagcaatagccgccgggtctgcaaagccctgtcagacagactgggcccttccaaggtcaagccatgtgtctgatgacattcctggtgaagcaaaggagaggaggatgggtcagccctcactgggtgtcacacactgagagaagtcctattgtaaagaaacggaaaaagtcacaaaaaagtttgtataaagacatatttttgtactacatggggactcttcctgcatgtcagcaataaaacttcctgatctggaaccactgtggaaaaa

SEQ ID NO: 72820 - DNA, 5602 bp, Homo sapiens
  misc_feature (2068)..(2068): n is a, c, g, or t
  misc_feature (2207)..(2207): n is a, c, g, or t
  misc_feature (2230)..(2230): n is a, c, g, or t
  misc_feature (2377)..(2377): n is a, c, g, or t
ataaatccccctttttgtgtctcagggcagacagaggttctggctgccttttacttgagtcatgggcgctccagagtggcagggtagtgtggtacagagagactcactgctccgtgtgtgtcctctggcacaccctccgctctggggccccactctcacctcgttcagttgacctgaaggagctccagcccactccagccccttcccacccatcatgccaggctataactccactggagcagtaggcggaccagctggaggccttctcagcagagcagagagctctcaaggagcagacagggggaggtgttggcaaggcagctgcaacaacaagttcaccccgctttggattttaaaaggatcgaaattcgaaatcctcttctggggttatgtgaggtgctgtggggtctttttccttcctcctttctttttggtaggcaagcaacataccaagttcctagaaaaggagaaaaacactgtggcagcccagagggccatagctaaagcgtgactcactcagagccgatcctactgacacacgtcccctccctccgtcccactctgccattgccccctcctgtcaggaccagactagggggtctgggactcccggggagccatgcaccccccacttgggtggtggtggcagggcaggggagtgttgccaaacctcaggaggacttggagctgcccgtgccacttcctgtggagagactccagtgcgcctgccgctcagccctgcagagcctcagctgtgcctgcccgtgccctggcagagggtgggaaagtcccaccagcagtgttgagttgaaagctcagccacactggcatgtgctctccggggcctgttgtcacaccatggcacctctcccctaccgcctccaagacagagtcttttcctaccaggtgtgccaaccatcggagatgagaggacaccagcttctactatttgccaggcattgggctaagtgccctccatgagattatcttatcttgctgaatcctaacccagttctggagtttggtgctgggatttcactgttgtacgcatgaggaaattgaggtttagcaagagattcacagagcaaggaagtggcagagccaggactaggaacctggctcccaaacccaccgtactttctcctgagctgtcctcctctcagcgtcttgagcctcagagacccacaggatgcatttgcagcttccgcggccatctctgaccaggggagaaaacccacagtgcctctgctctgtgggaaccttctggacaagaggcccgagcagccccatattcagggcagcggcactggagcttcagagctagagcagcccactccttgacgtgcaagtgaccctttgcagtgacccttcacctgtgcgatcaggctctagccgcctgcgggccaccagtcagactcctatggcagctgacagggcggacctgtataggcgctggagttggcgtttccgtggggaatccagaggacgggctggcctttgttttgcatcgagccctttgccagcagaattccccgagatcaccgagggctctcagagccgcctggatgcggctcccggggaaatccgccagcagccacacatgccctctgcctctgagagctgattgtagggagaggcagcccaaggcccccatggagctctccttcctgttgtcctcccagcttctccccctagcttctccacccagccagccgacacaggagcagggcagttgggtagagaggcatccttcctcactgcctgccccagtgggccaggaaacctttcccaggcctcttagacagggcctgcccaccctcccagcccccagtgtggtgtaaggtgtaagggtcctctcggggcacttccttttgtccacatgtgagttttctccaaaggatcagagcccaaagctgccctgccccacgcctttcagagggagggtctgtgatgttctagccagggcagagtcacaagtacgaggtaagggatgagtcagctttgatggaacagaaggaaaagtcattcggggcctggggccctgcccagggacacatctgggcatgangcagctgtcagttgtgtgtgcagctctggggccctgcagacctggtcttggatcctgctcttctgctcaccagctgcatgaccttggccaagtcctttcacttccctgtgcctttgttgtatcatctgaaacaggaccntgagaaaatccccctcattggcnactgtcagtttcttcctctgcagtggttgtggggccaagtgagaactgacatattccgtggttcggaggtggctcggggccagcccttgggtcaccttccaaggtggagtcactcacctctgctggacttccttttcctcatgtgtnaatgaggaaattgaactaaatctcaggtcactcccagtctagaatattacgtgaggctgtttttgagaaatctctgaaagttgttctaagccctaagctgtaccccgagattcagcccgggcagcaggtccagggatggcctgtgcaacactcagatacctgggagagaagccgatccctgctgggacagctcggctggtggccagaaaagtctggggcctgattcctctgctctgctccctggagagggggtcggggcagctgcttcaccctctgacgagaagcctacctcctactgttcaggattgggtgttggcccagtgaggtgtgtcctgcctgcgtgtcttgtgcctgttgctatagacactgaggtttgttcactctgtctcccactcctaggacacatcggataaccatcaccaacttctgcctcgggaagcatctggtgagcgagggggacctgctgaaggaccagagagggagccctgcctacatcagtcccgacgtgctcagcggccggccgtaccgtggcaagcccagtgacatgtgggccctgggcgtggtgctcttcaccatgctgtatggccagttccccttctacgacagcatcccgcaggagctcttccgcaagatcaaggctgccgagtataccattcctgaggatggacgggtttctgagaacaccgtgtgtctcatccggaagctgctggtccttgacccccagcagcgcctggccgccgccgacgtcctggaggccctcagtgccatcattgcatcatggcagtccctgtcatctctgagtgggcctttgcaagtggttcctgacattgatgaccaaatgagcaatgcggatagctcccaggaggcgaaggtgacggaggagtgctcccagtacgagtttgagaactacatgcgtcagcagctgctgctggccgaggagaagagctccatccatgacgcccggagctgggtacccaagcggcagttcggcagcgcaccaccggtgcgacggctgggccacgacgcacagcccatgacctccttggacacggccatcctggcgcagcgctacctgcggaaataacagcctcagccggggccaccagcactgctgccacttcttccagccccagccaaaggcgtggctgtcagggctgggccctgtagtgctggactctcccgggccacaatagggacagggcagggacagggacagcccaggtcacacgtggggtcagcagaggtaccacgaagctaccttttgggatgattgctcgattgtttggtttttaaatctgagaagcctagataactaatctgcttttaatcacgatgttttaatctacctctgtctctttaaccatgctgtctctggactgagcaagagggaggagggagcctgctcaccccactccagggccttccccagcggccaccaactgacctggggcgctgctccccacagtccaaataagctgaaagtgcagctcgctgcaggccccagagcgagcttcccctcctccctgctctcccaggcccctgccacagcctctttccgtccctctctttctgatccaggcccctcagtccaagctttggaaaaccttcacctcatcttaaaccgaactcaaatatatttatttttttaccataccaacttctctcccatctctaggtggctcagtccatggccactccctgcccccagcctggctggacagcaaggaatccacagcccacacgtgagctccctcctcacccccaggcagggaagcccctcctgccagtccctgtcccctttcagcccaccagtccctctctgctgccggtgatgggaggcctttctagacctggctctttctctcccgtctcagtggcttctctgaggtgctgtacacgcgcgttaacctgttcccttctctatccttccccgtggtactgagctcacgtggactcccagtgcgaaggggcccatgggttgggctgcaggcctggccgtgagcgggggctgcctgcacgctcccctagcctactcttgtgtttaggggatggtgggaacatatcccagtgcccttgcctcataatagatgtggtgactctcccggtagaccctagcaagggtcctccatggtggtgagggactcaggagaattgtagggattgggggaccctgcctgcctggcttgagaacagccctgctgcccttttgagccgagattttgaagtggatgcccgtcttgccagaaatgctgttctcaccagaatgccccctccccttgcccttactggacttggccctgcctgatgccaagcaaagacccttccccagaggcctaccccccatatgtcctcagagaggctgagtgtcccctccaggcagtcatgggccctgaggcccctcctgcctggccctgctccccagtggggaggtgactgtgtttcccagagtgtgagccgctctcctccccctaaaaagctgactcactgtgagtgaccttgggcaagttcccaaacctccttgtgcctcagtttccccatctggaaaaaatggggccacctcttgccagcagtagcagggctgcccacgcccctttctccccatgccccatccagcacttgggcgactcatgcctctgcctcagtgggcctgtgggagcctactggagcccagcacttactccccctgagcagcgagcctgcgtctgtctcagctgtccagcgctgagggccagggtcttgtgctgtggggctgggggatgccctcttttctatatttatttcatagaaagtctcctgcgggagcggaaatgcagtccggcctagggctcccagcccttgactgtcctcctgtgagggcctgaagctgggccagggcccgtcgcagcggagccccctctcagcagcccaccgggtccctccaggctgctgcccgtgcgtggtctttctcctccttttcaaagcaatagccgccgggtctgcaaagccctgtcagacagactgggcccttccaaggtcaagccatgtgtctgatgacattcctggtgaagcaaaggagaggaggatgggtcagccctcactgggtgtcacacactgagagaagtcctattgtaaagaaacggaaaaagtcacaaaaaagtttgtataaagacatatttttgtactacatggggactcttcctgcatgtcagcaataaaacttcctgatctggaaccactgtggaaaaa

SEQ ID NO: 72821 - DNA, 2342 bp, Homo sapiens
  misc_feature (18)..(18): n is a, c, g, or t
  misc_feature (24)..(24): n is a, c, g, or t
  misc_feature (33)..(33): n is a, c, g, or t
cgtagaggggcacagcantgtctngagtcgagnagaggtggcggcgccgcagccatggagggaggcggcggcggcggcggcggcggctcgggtggctgcgctgggaggcggcggtgagaggctcgcacgcctccagcccggccccggccccccgggagggagagccgagcagccccggctctgcgctacctgcggaaataacagcctcagccggggccaccagcactgctgccacttcttccagccccagccaaaggcgtggctgtcagggctgggccctgtagtgctggactctcccgggccacaatagggacagggcagggacagggacagcccaggtcacacgtggggtcagcagaggtaccacgaagctaccttttgggatgattgctcgattgtttggtttttaaatctgagaagcctagataactaatctgcttttaatcacgatgttttaatctacctctgtctctttaaccatgctgtctctggactgagcaagagggaggagggagcctgctcaccccactccagggccttccccagcggccaccaactgacctggggcgctgctccccacagtccaaataagctgaaagtgcagctcgctgcaggccccagagcgagcttcccctcctccctgctctcccaggcccctgccacagcctctttccgtccctctctttctgatccaggcccctcagtccaagctttggaaaaccttcacctcatcttaaaccgaactcaaatatatttatttttttaccataccaacttctctcccatctctaggtggctcagtccatggccactccctgcccccagcctggctggacagcaaggaatccacagcccacacgtgagctccctcctcacccccaggcagggaagcccctcctgccagtccctgtcccctttcagcccaccagtccctctctgctgccggtgatgggaggcctttctagacctggctctttctctcccgtctcagtggcttctctgaggtgctgtacacgcgcgttaacctgttcccttctctatccttccccgtggtactgagctcacgtggactcccagtgcgaaggggcccatgggttgggctgcaggcctggccgtgagcgggggctgcctgcacgctcccctagcctactcttgtgtttaggggatggtgggaacatatcccagtgcccttgcctcataatagatgtggtgactctcccggtagaccctagcaagggtcctccatggtggtgagggactcaggagaattgtagggattgggggaccctgcctgcctggcttgagaacagccctgctgcccttttgagccgagattttgaagtggatgcccgtcttgccagaaatgctgttctcaccagaatgccccctccccttgcccttactggacttggccctgcctgatgccaagcaaagacccttccccagaggcctaccccccatatgtcctcagagaggctgagtgtcccctccaggcagtcatgggccctgaggcccctcctgcctggccctgctccccagtggggaggtgactgtgtttcccagagtgtgagccgctctcctccccctaaaaagctgactcactgtgagtgaccttgggcaagttcccaaacctccttgtgcctcagtttccccatctggaaaaaatggggccacctcttgccagcagtagcagggctgcccacgcccctttctccccatgccccatccagcacttgggcgactcatgcctctgcctcagtgggcctgtgggagcctactggagcccagcacttactccccctgagcagcgagcctgcgtctgtctcagctgtccagcgctgagggccagggtcttgtgctgtggggctgggggatgccctcttttctatatttatttcatagaaagtctcctgcgggagcggaaatgcagtccggcctagggctcccagcccttgactgtcctcctgtgagggcctgaagctgggccagggcccgtcgcagcggagccccctctcagcagcccaccgggtccctccaggctgctgcccgtgcgtggtctttctcctccttttcaaagcaatagccgccgggtctgcaaagccctgtcagacagactgggcccttccaaggtcaagccatgtgtctgatgacattcctggtgaagcaaaggagaggaggatgggtcagccctcactgggtgtcacacactgagagaagtcctattgtaaagaaacggaaaaagtcacaaaaaagtttgtataaagacatatttttgtactacatggggactcttcctgcatgtcagcaataaaacttcctgatctggaaccactgtggaaaaa

SEQ ID NO: 72822 - DNA, 2626 bp, Homo sapiens
  misc_feature (18)..(18): n is a, c, g, or t
  misc_feature (24)..(24): n is a, c, g, or t
  misc_feature (33)..(33): n is a, c, g, or t
cgtagaggggcacagcantgtctngagtcgagnagaggtggcggcgccgcagccatggagggaggcggcggcggcggcggcggcggctcgggtggctgcgctgggaggcggcggtgagaggctcgcacgcctccagcccggccccggccccccgggagggagagccgagcagccccggctctgggctacggactatgggcgaatagctctgaccacccggcgaagagctgagaatgaagcggagagcatcagacagaggagctggggaaacgtcggccagggccaaggctctaggaagtgggatttctggaaataatgcaaagagagctggaccattcatccttggtccccgtctgggcaactcaccggtgccaagcatagtgcagtgtttggcgaggaaagatggcacggatgacttctatcagctgaagatcctgaccctggaggagaggggggaccaaggcatagagagccaggaagagcggcagggcaagatgctgctgcacaccgagtactcactgctgtctctcctgcacacgcaggatggcgtggtgcaccaccacggcctcttccaggaccgcacctgtgaaatcgttgaggacacagaatccagccggatggttaagaagatgaagaagcgcatctgcctcgtcctggactgcctctgtgctcatgacttcagcgataagaccgctgacctcatcaacctgcagcactacgtcatcaaggagaagaggctcagcgagagggagactgtggtaatcttctacgacgtggtccgcgtggtggaggccctgcaccagaaaaatatcgtgcacagagacctgaagctggggaacatggtgctcaacaagaggacacatcggataaccatcaccaacttctgcctcgggaagcatctggtgagcgagggggacctgctgaaggaccagagagggagccctgcctacatcagtcccgacgtgctcagcggccggccgtaccgtggcaagcccagtgacatgtgggccctgggcgtggtgctcttcaccatgctgtatggccagttccccttctacgacagcatcccgcaggagctcttccgcaagatcaaggctgccgagtataccattcctgaggatggacgggtttctgagaacaccgtgtgtctcatccggaagctgctggtccttgacccccagcagcgcctggccgccgccgacgtcctggaggccctcagtgccatcattgcatcatggcagtccctgtcatctctgagtgggcctttgcaagtggttcctgacattgatgaccaaatgagcaatgcggatagctcccaggaggcgaaggtgacggaggagtgctcccagtacgagtttgagaactacatgcgtcagcagctgctgctggccgaggagaagagctccatccatgacgcccggagctgggtacccaagcggcagttcggcagcgcaccaccggtgcgacggctgggccacgacgcacagcccatgacctccttggacacggccatcctggcgcagcgctacctgcggaaataacagcctcagccggggccaccagcactgctgccacttcttccagccccagccaaaggcgtggctgtcagggctgggccctgtagtgctggactctcccgggccacaatagggacagggcagggacagggacagcccaggtcacacgtggggtcagcagaggtaccacgaagctaccttttgggatgattgctcgattgtttggtttttaaatctgagaagcctagataactaatctgcttttaatcacgatgttttaatctacctctgtctctttaaccatgctgtctctggactgagcaagagggaggagggagcctgctcaccccactccagggccttccccagcggccaccaactgacctggggcgctgctccccacagtccaaataagctgaaagtgcagctcgctgcaggccccagagcgagcttcccctcctccctgctctcccaggcccctgccacagcctctttccgtccctctctttctgatccaggcccctcagtccaagctttggaaaaccttcacctcatcttaaaccgaactcaaatatatttatttttttaccataccaacttctctcccatctctaggtggctcagtccatggccactccctgcccccagcctggctggacagcaaggaatccacagcccacacgtgagctccctcctcacccccaggcagggaagcccctcctgccagtccctgtcccctttcagcccaccagtccctctctgctgccggtgatgggaggcctttctagacctggctctttctctcccgtctcagtggcttctctgaggctcctccttttcaaagcaatagccgccgggtctgcaaagccctgtcagacagactgggcccttccaaggtcaagccatgtgtctgatgacattcctggtgaagcaaaggagaggaggatgggtcagccctcactgggtgtcacacactgagagaagtcctattgtaaagaaacggaaaaagtcacaaaaaagtttgtataaagacatatttttgtactacatggggactcttcctgcatgtcagcaataaaacttcctgatctggaaccactgtggaaaaa

SEQ ID NO: 72823 - DNA, 734 bp, Homo sapiens
ctctttatcctgtcccccctgtttcctttctctcccatttgggctcccccaattttccctattggccacccttttcggtggtcgacctctagtgcctctgcctcagtgggcctgtgggtagcctactggagcccagcacttactccccctgagcagtcgtagccctgcgttcttgtctccatgccttgttcccccaagtgccggccctgggtaaggtgggtccccaaaggggttcctttgtgtctgctgtgcggctctgtgggggatgccctcttttctatatttatttcatagaaagtctcctgcgggagcggaaatgcagtccggcctagggctcccagcccttgactgtcctcctgtgagggcctgaagctgggccagggcccgtcgcagcggagccccctctcagcagcccaccgggtccctccaggctgctgcccgtgcgtggtctttctcctccttttcaaagcaatagccgccgggtctgcaaagccctgtcagacagactgggcccttccaaggtcaagccatgtgtctgatgacattcctggtgaagcaaaggagaggaggatgggtcagccctcactgggtgtcacacactgagagaagtcctattgtaaagaaacggaaaaagtcacaaaaaagtttgtataaagacatatttttgtactacatggggactcttcctgcatgtcagcaataaaacttcctgatctggaaccactgtggaaaaa

SEQ ID NO: 72824 - DNA, 258 bp, Homo sapiens
ccagggccgccgaccctggcaatgactgtcaccagctggagggaaggtatccgttcactcatggagtatctgctgggcctggcagtgggctgcagtggttttatatatatgtttatacatttgtttttccttgtgaaatttttagttgtggtggaatttttctggtggaggggggcagacattaagcatataaacacaaataaatacatagttacaaaatctggaaagtactatggaggaaaattacagaccaccatg

SEQ ID NO: 72825 - DNA, 2481 bp, Homo sapiens
  misc_feature (18)..(18): n is a, c, g, or t
  misc_feature (24)..(24): n is a, c, g, or t
  misc_feature (33)..(33): n is a, c, g, or t
cgtagaggggcacagcantgtctngagtcgagnagaggtggcggcgccgcagccatggagggaggcggcggcggcggcggcggcggctcgggtggctgcgctgggaggcggcggtgagaggctcgcacgcctccagcccggccccggccccccgggagggagagccgagcagccccggctctgggctacggactatgggcgaatagctctgaccacccggcgaagagctgagaatgaagcggagagcatcagacagaggagctggggaaacgtcggccagggccaaggctctaggaagtgggatttctggaaataatgcaaagagagctggaccattcatccttggtccccgtctgggcaactcaccggtgccaagcatagtgcagtgtttggcgaggaaagatggcacggatgacttctatcagctgaagatcctgaccctggaggagaggggggaccaaggcatagagagccaggaagagcggcagggcaagatgctgctgcacaccgagtactcactgctgtctctcctgcacacgcaggatggcgtggtgcaccaccacggcctcttccaggaccgcacctgtgaaatcgttgaggacacagaatccagccggatggttaagaagatgaagaagcgcatctgcctcgtcctggactgcctctgtgctcatgacttcagcgataagaccgctgacctcatcaacctgcagcactacgtcatcaaggagaagaggctcagcgagagggagactgtggtaatcttctacgacgtggtccgcgtggtggaggccctgcaccagaaaaatatcgtgcacagagacctgaagctggggaacatggtgctcaacaagaggacacatcggataaccatcaccaacttctgcctcgggaagcatctggtgagcgagggggacctgctgaaggaccagagagggagccctgcctacatcagtcccgacgtgctcagcggccggccgtaccgtggcaagcccagtgacatgtgggccctgggcgtggtgctcttcaccatgctgtatggccagttccccttctacgacagcatcccgcaggagctcttccgcaagatcaaggctgccgagtataccattcctgaggatggacgggtttctgagaacaccgtgtgtctcatccggaagctgctggtccttgacccccagcagcgcctggccgccgccgacgtcctggaggccctcagtgccatcattgcatcatggcagtccctgtcatctctgagtgggcctttgcaagtggttcctgacattgatgaccaaatgagcaatgcggatagctcccaggaggcgaaggtgacggaggagtgctcccagtacgagtttgagaactacatgcgtcagcagctgctgctggccgaggagaagagctccatccatgacgcccggagctgggtacccaagcggcagttcggcagcgcaccaccggtgcgacggctgggccacgacgcacagcccatgacctccttggacacggccatcctggcgcagcgctacctgcggaaataacagcctcagccggggccaccagcactgctgccacttcttccagccccagccaaaggcgtggctgtcagggctgggccctgtagtgctggactctcccgggccacaatagggacagggcagggacagggacagcccaggtcacacgtggggtcagcagaggtaccacgaagctaccttttgggatgattgctcgattgtttggtttttaaatctgagaagcctagataactaatctgcttttaatcacgatgttttaatctacctctgtctctttaaccatgctgtctctggactgagcaagagggaggagggagcctgctcaccccactccagggccttccccagcggccaccaactgacctggggcgctgctccccacagtccaaataagctgaaagtgcagctcgctgcaggccccagagcgagcttcccctcctccctgctctcccaggcccctgccacagcctctttccgtccctctctttctgatccaggcccctcagtccaagctttggaaaaccttcacctcatcttaaaccgaactcaaatatatttatttttttaccataccaacttctctcccatctctaggtggctcagtccatggccactccctgcccccagcctggctggacagcaaggaatccacagcccacacgtgagctccctcctcacccccaggcagggaagcccctcctgccagtccctgtcccctttcagcccaccagtccctctctgctgccggtgatgggaggcctttctagacctggctctttctctcccgtctcagtggcttctctgaggactgagagaagtcctattgtaaagaaacggaaaaagtcacaaaaaagtttgtataaagacatatttttgtactacatggggactcttcctgcatgtcagcaataaaacttcctgatctggaaccactgtggaaaaa

SEQ ID NO: 72826 - DNA, 1492 bp, Homo sapiens
  misc_feature (18)..(18): n is a, c, g, or t
  misc_feature (24)..(24): n is a, c, g, or t
  misc_feature (33)..(33): n is a, c, g, or t
cgtagaggggcacagcantgtctngagtcgagnagaggtggcggcgccgcagccatggagggaggcggcggcggcggcggcggcggctcgggtggctgcgctgggaggcggcggtgagaggctcgcacgcctccagcccggccccggccccccgggagggagagccgagcagccccggctctgggctacggactatgggcgaatagctctgaccacccggcgaagagctgagaatgaagcggagagcatcagacagaggagctggggaaacgtcggccagggccaaggctctaggaagtgggatttctggaaataatgcaaagagagctggaccattcatccttggtccccgtctgggcaactcaccggtgccaagcatagtgcagtgtttggcgaggaaagatggcacggatgacttctatcagctgaagatcctgaccctggaggagaggggggaccaaggcatagagagccaggaagagcggcagggcaagatgctgctgcacaccgagtactcactgctgtctctcctgcacacgcaggatggcgtggtgcaccaccacggcctcttccaggaccgcacctgtgaaatcgttgaggacacagaatccagccggatggttaagaagatgaagaagcgcatctgcctcgtcctggactgcctctgtgctcatgacttcagcgataagaccgctgacctcatcaacctgcagcactacgtcatcaaggagaagaggctcagcgagagggagactgtggtaatcttctacgacgtggtccgcgtggtggaggccctgcaccagaaaaatatcgtgcacagagacctgaagctggggaacatggtgctcaacaagaggacacatcggataaccatcaccaacttctgcctcgggaagcatctggtgagcgagggggacctgctgaaggaccagagagggagccctgcctacatcagtcccgacgtgctcagcggccggccgtaccgtggcaagcccagtgacatgtgggccctgggcgtggtgctcttcaccatgctgtatggccagttccccttctacgacagcatcccgcaggagctcttccgcaagatcaaggctgccgagtataccattcctgatgctgtacacgcgcgttaacctgttcccttctctatccttccccgtggtactgagctcacgtggactcccagctgctgcccgtgcgtggtctttctcctccttttcaaagcaatagccgccgggtctgcaaagccctgtcagacagactgggcccttccaaggtcaagccatgtgtctgatgacattcctggtgaagcaaaggagaggaggatgggtcagccctcactgggtgtcacacactgagagaagtcctattgtaaagaaacggaaaaagtcacaaaaaagtttgtataaagacatatttttgtactacatggggactcttcctgcatgtcagcaataaaacttcctgatctggaaccactgtggaaaaa

SEQ ID NO: 72827 - DNA, 1349 bp, Homo sapiens
taaagatagggcagatagccccaacacactaccctgcacacagaaaataatcattggtcttcactagtgaaataagcagtgggttgctaagggccaacttgcctgaacaggctacacaagaacctcagagcccaacccattgtgaagaaacatgggttacttctgaggttctagaattcccagaagctctgcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggtgagttcttttcacttgaaaacccttctgatgctgaggctttatatgagacttcttcaggcctgaacactttaagtgagcatggttccagtgagcatggttcaagcaagcacactgtggccgagcacacttctggagaacatgctgagagtgagcatgcttcaggtgagcccgctgcgactgaacatgctgaaggtgagcatactgtaggtgagcagccttcaggagaacagccttcaggtgaacacctctccggagaacagcctttgagtgagcttgagtcaggtgaacagccttcagatgaacagccttcaggtgaacatggctccggtgaacagccttctggtgagcaggcctcgggtgaacagccttcaggtgagcacgcttcaggggaacaggcttcaggtgcaccaatttcaagcacatctacaggcacaatattaaattgctacacatgtgcttatatgaatgatcaaggaaaatgtcttcgtggagagggaacctgcatcactcagaattcccagcagtgcatgttaaagaagatctttgaaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatggttaaagcaaacaggct

SEQ ID NO: 72828 - DNA, 1064 bp, Homo sapiens
taaagatagggcagatagccccaacacactaccctgcacacagaaaataatcattggtcttcactagtgaaataagcagtgggttgctaagggccaacttgcctgaacaggctacacaagaacctcagagcccaacccattgtgaagaaacatgggttacttctgaggttctagaattcccagaagctctgcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggtgaacagccttcagatgaacagccttcaggtgaacatggctccggtgaacagccttctggtgagcaggcctcgggtgaacagccttcaggtgagcacgcttcaggggaacaggcttcaggtgcaccaatttcaagcacatctacaggcacaatattaaattgctacacatgtgcttatatgaatgatcaaggaaaatgtcttcgtggagagggaacctgcatcactcagaattcccagcagtgcatgttaaagaagatctttgaaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatggttaaagcaaacaggct

SEQ ID NO: 72829 - DNA, 1139 bp, Homo sapiens
taaagatagggcagatagccccaacacactaccctgcacacagaaaataatcattggtcttcactagtgaaataagcagtgggttgctaagggccaacttgcctgaacaggctacacaagaacctcagagcccaacccattgtgaagaaacatgggttacttctgaggttctagaattcccagaagctctgcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggtgagcagccttcaggagaacagccttcaggtgaacacctctccggagaacagcctttgagtgagcttgagtcaggtgaacagccttcagatgaacagccttcaggtgaacatggctccggtgaacagccttctggtgagcaggcctcgggtgaacagccttcaggtgagcacgcttcaggggaacaggcttcaggtgcaccaatttcaagcacatctacaggcacaatattaaattgctacacatgtgcttatatgaatgatcaaggaaaatgtcttcgtggagagggaacctgcatcactcagaattcccagcagtgcatgttaaagaagatctttgaaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatggttaaagcaaacaggct

SEQ ID NO: 72830 - DNA, 1292 bp, Homo sapiens
taaagatagggcagatagccccaacacactaccctgcacacagaaaataatcattggtcttcactagtgaaataagcagtgggttgctaagggccaacttgcctgaacaggctacacaagaacctcagagcccaacccattgtgaagaaacatgggttacttctgaggttctagaattcccagaagctctgcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggtgagttcttttcacttgaaaacccttctgatgctgaggctttatatgagacttcttcaggcctgaacactttaagtgagcatggttccagtgagcatggttcaagcaagcacactgtggccgagcacacttctggagaacatgctgagagtgagcatgcttcaggtgagcccgctgcgactgaacatgctgaaggtgagcatactgtaggtgagcagccttcaggagaacagccttcaggtgaacacctctccggagaacagcctttgagtgagcttgagtcaggtgaacagccttcagatgaacagccttcaggtgaacatggctccggtgaacagccttctggtgagcaggcctcgggtgaacagccttcaggcacaatattaaattgctacacatgtgcttatatgaatgatcaaggaaaatgtcttcgtggagagggaacctgcatcactcagaattcccagcagtgcatgttaaagaagatctttgaaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatggttaaagcaaacaggct

SEQ ID NO: 72831 - DNA, 1184 bp, Homo sapiens
taaagatagggcagatagccccaacacactaccctgcacacagaaaataatcattggtcttcactagtgaaataagcagtgggttgctaagggccaacttgcctgaacaggctacacaagaacctcagagcccaacccattgtgaagaaacatgggttacttctgaggttctagaattcccagaagctctgcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggtgagcccgctgcgactgaacatgctgaaggtgagcatactgtaggtgagcagccttcaggagaacagccttcaggtgaacacctctccggagaacagcctttgagtgagcttgagtcaggtgaacagccttcagatgaacagccttcaggtgaacatggctccggtgaacagccttctggtgagcaggcctcgggtgaacagccttcaggtgagcacgcttcaggggaacaggcttcaggtgcaccaatttcaagcacatctacaggcacaatattaaattgctacacatgtgcttatatgaatgatcaaggaaaatgtcttcgtggagagggaacctgcatcactcagaattcccagcagtgcatgttaaagaagatctttgaaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatggttaaagcaaacaggct

SEQ ID NO: 72832 - DNA, 999 bp, Homo sapiens
taaagatagggcagatagccccaacacactaccctgcacacagaaaataatcattggtcttcactagtgaaataagcagtgggttgctaagggccaacttgcctgaacaggctacacaagaacctcagagcccaacccattgtgaagaaacatgggttacttctgaggttctagaattcccagaagctctgcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccagcaggcctcgggtgaacagccttcaggtgagcacgcttcaggggaacaggcttcaggtgcaccaatttcaagcacatctacaggcacaatattaaattgctacacatgtgcttatatgaatgatcaaggaaaatgtcttcgtggagagggaacctgcatcactcagaattcccagcagtgcatgttaaagaagatctttgaaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatggttaaagcaaacaggct

SEQ ID NO: 72833 - DNA, 917 bp, Homo sapiens
taaagatagggcagatagccccaacacactaccctgcacacagaaaataatcattggtcttcactagtgaaataagcagtgggttgctaagggccaacttgcctgaacaggctacacaagaacctcagagcccaacccattgtgaagaaacatgggttacttctgaggttctagaattcccagaagctctgcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggcacaatattaaattgctacacatgtgcttatatgaatgatcaaggaaaatgtcttcgtggagagggaacctgcatcactcagaattcccagcagtgcatgttaaagaagatctttgaaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatggttaaagcaaacaggct

SEQ ID NO: 72834 - DNA, 1019 bp, Homo sapiens
taaagatagggcagatagccccaacacactaccctgcacacagaaaataatcattggtcttcactagtgaaataagcagtgggttgctaagggccaacttgcctgaacaggctacacaagaacctcagagcccaacccattgtgaagaaacatgggttacttctgaggttctagaattcccagaagctctgcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggtgagcagccttcaggagaacagccttcaggtgaacacctctccggagaacagcctttgagtgagcttgagtcaggtgaacagccttcagatgaacagccttcaggtgaacatggctccggtgaacagccttctggtgagcaggcctcgggtgaacagccttcaggtgagcacgcttcaggggaacaggcttcaggtgcaccaatttcaagcacatctacaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatggttaaagcaaacaggct

SEQ ID NO: 72835 - DNA, 797 bp, Homo sapiens
taaagatagggcagatagccccaacacactaccctgcacacagaaaataatcattggtcttcactagtgaaataagcagtgggttgctaagggccaacttgcctgaacaggctacacaagaacctcagagcccaacccattgtgaagaaacatgggttacttctgaggttctagaattcccagaagctctgcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggaacatcaagtcagcctaatgagctttctggctccatagatcatcaaacttcagttcagcaacttccaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatggttaaagcaaacaggct

SEQ ID NO: 72836 - DNA, 761 bp, Homo sapiens
taaagatagggcagatagccccaacacactaccctgcacacagaaaataatcattggtcttcactagtgaaataagcagtgggttgctaagggccaacttgcctgaacaggctacacaagaacctcagagcccaacccattgtgaagaaacatgggttacttctgaggttctagaattcccagaagctctgcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggtgagtgtttgatctaggcttcaggtaaatacaaaaggggtctcccttaagacatttcaggccttgaagaaggaagaccagtctctcagtcacccaaaccaatctgagtcagaatcaagagcagctaaacaagtccaactcggagagctcctgaaccagttgatttctctagtcatagctttacagtcagagggtcccactggcttggcacagtctggtttctacttattttagccactcaacatttatacctgatgctgcatgagatgaaaaagtaggcttaggggttctgtagaagcccaatgaaggtttgtcccaccaattaaatgtgagggatccttgtgtggttaatgtgccaaggaaagatgggagatgggaagatgtgatgtgttcagaaaacaacctcagaacacgacagagcctca

SEQ ID NO: 72837 - DNA, 858 bp, Homo sapiens
tatgatgtgcaagcaaagaggttaaaaaagtcctgagaaaaggatgcagaatttgatgagtagatctctatgacttttgagagaggtttcggcatagtagggtcatgattcaaactgtgaggggccaaggtgaggaggataggcagactctgggaaggctgtaaggaaaggaaggatagtgctaggggagtagcacgattaagagaaagtattttaaatttggggtaacctgagcatccttgtaaaccaaaaaaggagtccatagaaacggactgacaatataagaaaggagtgggcaactgatggggggcaagttcccagaggaagcaaatagaagagaaagagaagggataatggacaagtggaggtcttgaccatcctgcatggagacactgagcatcacagataaaggctaaggttggaggacgaagctttctgctcactagtctgtctctgctcctttcaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatggttaaagcaaacaggct

SEQ ID NO: 72838 - DNA, 387 bp, Homo sapiens
tgtcacttaaacgtgttttcttctttggtgctcagaattccagctacagcggtgacagcagattctctactttgtcatcatccagggaggagaagttggttggtttccatttaaatctttcacattctcttcagaaaccgcagattttgtagcatgcaatcttgtgtgtgtggattcagctctacttttctctttcggtgtctgtttgacggatttttgtttgggtagctgtgttattgacgtgaaaagcagcagttaacatgagctccttcattcagatgtactccagtgtgctgcgtttgaccacaccagctcgaatgtgaattgtggcattcagctggctgcaatgaaaggacgtgtttttgtgtatattttctaattagaatt

SEQ ID NO: 72839 - DNA, 358 bp, Homo sapiens
gatagaagtgggagtgaggagacagcaattgattcaaggaaactctgagaaaaaataaaaagaaacttcacttactatctccaaatgttattttgctacctaaggaatgtagacaccatgcatccaaactcccgcctgtcatcggtggatgaacaatacatttttcagcattgacagtaaacaactattcaacttttgcttcattcctctcactaaagagaaggttcattaccttatgaagtagtctagttgtgactgatacctctgttgtgagttctttggttgagcttctttgtatcagtaacaaaaggaagcatcattcagtctttctttgtaacttaatgtaagtctcttttgt

SEQ ID NO: 72840 - DNA, 249 bp, Homo sapiens
  misc_feature (209)..(210): n is a, c, g, or t
  misc_feature (218)..(220): n is a, c, g, or t
gctcaaatgctcctcccacctgggtgtcccaaagtgctggtattacaggtatgagccaccacacctggcagagatcactttttaccaagatacgcaatttactggagacaagctacccacatggagataactggcatcacagggctttgttttgttttgtttttgagacaggttccggctctgtcacccaggctggaggagcatttganntcaggagnnngagactatcctaaaacaaacaaacaaaca

SEQ ID NO: 72841 - DNA, 838 bp, Homo sapiens
gaagggcgtgtcggcccagcacaagtcctgagccccccaagaccggcgatgcccactggaccaaaaaggatgcaggatccacccagagactcagcaccaaacccaacacacgcacgccaccacagcaactgtgacagcggggggccctgcagaggcgaggggggagcgagtggggacagacaagggggacacgtcccgagctcctgtggccggtcctgggatgcgcttgtcgccccgggtggcacgtgtccacacacacacacagacacacacacacacacacacacgagggacttcggaaaactgtgtcttagggatcgggggtgggggtggggatttttttttcattatctttcctcttttgagtcttctctgccttttcttttcctctctatctctttactttcttccttttttaaaaaaatataataaaagacaagttattttaaaaagacataaaatgccatccgtggggggtgtggccggcgtggccacctcggggcccctcacgtgatctcctcggtccgtggttttctgtggattctctgtccggtccgtctcttcattgccgcctccggagtccactgcagaggggcagagtgaatgccggcggccaagtggcctccgggacaggtcctggagccctgctggactcagggtgggtggaggctgtgcctgtggacggccggggtggccaggacggccaagggctgggaggcacgtcccccagcccagcccccatgtacactgtagtcgttctattgtacagaaaaaaatatttctatatttgcaatgtttgctgtaaaatgagaaagaaaaaaagactatgtctactaaa

SEQ ID NO: 72842 - DNA, 5999 bp, Homo sapiens
  misc_feature (3494)..(3494): n is a, c, g, or t
ccggcggcgcctgagcccagccgaggatggagaaccggcctgggtccttccagtacgtccctgtgcagctgcaagggggggcaccctggggcttcacccttaaggggggtctggaacactgtgagccgctcacagtgtctaagattgaagatggaggcaaggcagctttgtcccagaagatgaggactggtgatgagctggtgaatatcaatggcactccattatatggctcccgccaagaggccctcattctcatcaaaggctccttccggattctcaagctgattgtcaggaggaggaacgcccctgtcagtaggccgcactcatggcatgtggccaagctgctggagggatgccctgaagcagccaccaccatgcatttcccttctgaagccttcagcttgtcctggcattctggctgcaacacaagtgacgtgtgtgtgcagtggtgtccactctcccggcattgcagcaccgagaaaagcagctccattggcagcatggagagcctggagcaaccaggccaagccacctatgagagccatctgttgcctattgaccagaacatgtaccctaaccagcgtgactcagcctacagctccttctcggccagctcaaatgcttctgactgtgccctttccctcaggccagaggagccagcctctacagactgcatcatgcaaggcccagggccaactaaggcccccagtggccggcctaatgtggctgagacctcaggaggtagtcggcgcaccaatgggggccacctgacccccagctctcagatgtcatcccgtccacaggagggataccagtcagggcccgccaaagcagtcaggggcccaccacaacctccagtgaggcgggacagccttcaggcctccagagcccaactcctcaatggagagcagcgcagggcatctgagcctgtggtccccttgccacagaaggagaaactgagcttagagcctgtgctacccgcaaggaaccctaataggttctgttgcctcagtgggcatgaccaagtgacaagtgagggccatcagaactgtgagttcagtcagcctcctgaatccagccaacagggctctgagcatctactgatgcaggcctcaaccaaagctgttggatccccaaaagcctgtgacagagcttccagcgtggattccaacccactcaatgaggcttctgcagagctagctaaggcttcttttggcagacctccacatctcataggacccacagggcatcgccatagtgcccctgaacagctgctggcatcccacctgcagcatgtgcaccttgataccaggggcagcaaagggatggagctcccacccgtacaggatgggcaccagtggactctgtcccctttgcacagcagccacaaagggaagaaaagtccatgcccccctacaggaggaacccatgaccagtccagcaaagaaagaaagaccagacaagtggatgacaggtctttagttttgggacaccagagccaaagcagtcccccacatggagaggctgatggacacccctcagaaaaaggtttcctggacccaaacagaacaagcagagcagccagtgaattggccaaccagcaaccctctgcctctggctcccttgttcaacaagccacggactgttcttcaaccactaaagcagctagtggcacagaggcaggtgaagaaggggacagcgagcccaaggagtgcagccggatgggtggtaggcgaagtggagggacccggggccgctcgatccaaaaccggcggaagagtgagcgttttgctaccaatctgcgtaatgaaattcagaggaggaaggcccagctccagaaaagcaagggtcccttgtcacagctgtgtgacactaaggagccagtggaagagacccaggagcccccagaaagtcctccactcactgcctctaacacatctcttctatcttcatgtaaaaaacctcccagccccagagacaagctcttcaacaaaagcatgatgctcagagctaggtcttccgagtgcctcagccaagcccctgagagccatgaatctaggacaggcttagagggacgaataagccctggccagaggcctggccagtcctctttgggcctgaacacctggtggaaagcacctgacccatcctcctcagaccctgagaaagcacatgctcactgtggagtccgtggaggtcattggagatggtctccagagcataattcacagccacttgtggcagcagccatggaaggcccttccaacccaggtgacaacaaggaattgaaggcttctactgctcaagctggggaggatgccatcctcttgccttttgcagacagaagaaagttctttgaagagagtagcaaatccttatctacatctcatttgccaggtttaaccactcatagcaacaagacttttacccagagaccaaaacctatagaccaaaacttccagccaatgagctccagctgtagggaattgaggcgccatcccatggaccaatcatatcattccgcagaccaaccatatcatgccacagaccaatcatatcattccatgtcaccccttcagtcagaaactcccacttactcagaatgttttgcaagcaaaggtctagaaaattccatgtgttgtaagccactacactgtggtgattttgattaccacaggacctgctcttactcctgcagtgttcaaggagctctagtccatgatccttgcatttattgttctggggaaatctgccctgccttgctaaagagaaatatgatgccaaattgctacaactgccggtgccaccaccaccaatgcattcggtgttcagtttgctatcataatcctcagcacagtgccctcgaggacagcagcttggcacctggcaacacttggaaacccaggaagctgacagtgcaggaatttcctggggacaaatggaatccaataacaggaaacaggaagaccagccagtcagggagggaaatggctcattccaagactagcttttcatgggcaacccctttccatccttgccttgagaacccagcactggacttgtcaagctaccgagcaatttcttctcttgacctccttggagacttcaaacatgctttgaaaaaatcagaggaaacttcagtttatgaggaggggagctcccttgcctccatgccccacccactgcgcagccgtgccttctcagagagtcacatcagcttggcgccccaaagcacccgggcctgggggcagcataggagggagctctttagcaaaggtgatgagacccagtcggatcttctcggagccaggaagaaggcctttcctcctcctcgccctcctcctcccaactgggagaagtacaggctctttcgtgcagcccagcagcagaagcagcaacagcagcagcagaagcaacaggaggaggaggaggaggaggaagaagaagaagaagaggaagaggaagaggaggaggaggaggcagaggaggaggangaggagctgccaccccagtatttcagttcagaaacctctggttcctgtgctctcaatcctgaggaggtcctagagcagccacaacccctcagctttggccacctggagggctcgagacagggttcacaaagtgtcccagcagagcaagaatcctttgcactccattccagtgatttcttgcctccaataaggggtcacttgggatctcaacctgagcaggctcagcccccttgctactatggcattggtgggctttggaggacatcgggacaggaagccactgaatccgccaaacaagagtttcagcacttttcgcctccttcaggggccccaggaatccctacctcttactcagcttattacaatatttctgtggccaaggcagagctgctgaacaaactgaaagaccaacctgagatggcagagattggcctaggagaggaggaagttgaccatgaactggctcaaaaaaagatacagcttatcgaaagcatcagcagaaaactttctgtcttgcgggaggcccagcgagggctgctagaggacatcaatgccaattctgcccttggggaggaggtggaggccaacttaaaagccgtctgcaaatccaatgaatttgaaaagtaccacttgtttgttggggacctggacaaagtggtcaacctgttgctgtcactctctggacgactggcccgggtggagaatgctctgaacagcatcgattcagaggccaaccaggagaagttggtactgatagagaagaagcagcagctgacggggcagttggcagatgccaaggagctgaaggagcacgtggaccgccgggagaagttggtgtttggcatggtctcccgctacctgcctcaggaccagctccaagattaccagcactttgtcaagatgaaatctgctctcatcattgaacagcgagagctggaggagaagatcaagctcggggaagagcaactcaaatgtctcagggagagtctactcctggggcccagcaatttctaattctaccagcactctgccacagcatccctgcccagccatgtgggaagtgctttcaatcttctttgttagcagtttctcagcaagtagatagcaattagcagtttgttccagccctctaccctggatgtctctcactaccccttccctagcagtggtcctaaccagctaggagaccctggggaagccacaagcttctacccaagggagctgcagcaaggtgtgatcttagaaccacactctccttcccacagttgccaagggcaagtacttgctgcacagagaaccaaggaagtgccttcattctgctttgtactaggacaccaaagacatcaagtactcatcacccacccatatcatcaacagcctctaaaggctcagagggaatctgccttgcagctctactctgccccagggcttgtggccagccatttctcacagagagctggctgccttgagggcattcacctggcaccagtttcagggcctcacccaagctttgcaggggaaagcacagagggaggaattacactgaaaaaaatgcaagcaaaggttgagtacccccaggtgccccttaggaaggaaccaggtttaaataggctctacccttacctttcccagcagcaagttcaggggaagaggcctactcttagccctggctagtgtgaccctcttcctgtcctaagactttggtcctaccacctcttgtttcatctttcctttacattgctgggggttaccgcaggtgcctaccccagggcttcaccatatgggccattaatagctctactaaaactgacttctagatgtaggtttcattattgggggagggggttcttattgttatattttaaatggccttttgattttatttatttttatgttttgattatttttttcttttttaactaataaggcgagaagagggaagttggagagggaaaagttagcccagaaggaaagcattttctgcagatcagcctgaatccaccgtggctaggcatattcttgctcttctcgtgttgctcacaactacctgcctggatgaatttaggaaagttgcaggatacaaggttaaaacacaagatcaaatgaacaatccgaaaatgttattaagaaaacagttccggccgggcatggtggctcacgcctgaaatcccagcactttgggaggccgaggcaggtggatcacgaggtcaggagatcaagaccatcctggctaacacggtgaaaccctatctctactaaaaatacaaaaaattagccaggtgtggtggcacgcaccagtagtcccagctactcgggaggctgaggcaggagaattgcttgaacctggaaggcagagattgcagtgagctgagaccacaccactgcactccatcctgggcaacagagtgagactttgtctcaaaaagaaagaaagaaagaaagaaagaaagaaagaaaagaaagaaagaaagaaagaaagaaaacagttccatttacaatagcatc

SEQ ID NO: 72843 - DNA, 629 bp, Homo sapiens
aattttaactagatttccaggagattcatgaacatattacagcatgggaagtactgacttgttgaaaacatattcagtacatggtaaccattattatagtcctgatctactcaattcattttttccttatcccaggcatattcttgctcttctcgtgttgctcacaactacctgcctggatgaatttaggaaagttgcaggatacaaggttaaaacacaagatcaaatgaacaatccgaaaatgttattaagaaaacagttccggccgggcatggtggctcacgcctgaaatcccagcactttgggaggccgaggcaggtggatcacgaggtcaggagatcaagaccatcctggctaacacggtgaaaccctatctctactaaaaatacaaaaaattagccaggtgtggtggcacgcaccagtagtcccagctactcgggaggctgaggcaggagaattgcttgaacctggaaggcagagattgcagtgagctgagaccacaccactgcactccatcctgggcaacagagtgagactttgtctcaaaaagaaagaaagaaagaaagaaagaaagaaagaaaagaaagaaagaaagaaagaaagaaaacagttccatttacaatagcatc

SEQ ID NO: 72844 - DNA, 438 bp, Homo sapiens
ccggcggcgcctgagcccagccgaggatggagaaccggcctgggtccttccagtacgtccctgtgcagctgcaagggggggcaccctggggcttcacccttaaggggggtctggaacactgtgagccgctcacagtgtctaagattgaagatggaggcaaggcagctttgtcccagaagatgaggactggtgatgagctggtgaatatcaatggcactccattatatggctcccgccaagaggccctcattctcatcaaaggctccttccggattctcaagctgattgtcaggagactaagtttgctggcccctggtataaagcattctccaaaaagaagaccttgaggctctctctaaagcttaaaaagactgaaagagaaccatcgtagtctacaagtgagaatgaataaaaaaatcacagaatatttaagccaac

SEQ ID NO: 72845 - DNA, 5945 bp, Homo sapiens
  misc_feature (3440)..(3440): n is a, c, g, or t
ccggcggcgcctgagcccagccgaggatggagaaccggcctgggtccttccagtacgtccctgtgcagctgcaagggggggcaccctggggcttcacccttaaggggggtctggaacactgtgagccgctcacagtgtctaagattgaagatggaggcaaggcagctttgtcccagaagatgaggactggtgatgagctggtgaatatcaatggcactccattatatggctcccgccaagaggccctcattctcatcaaaggctccttccggattctcaagctgattgtcaggaggaggaacgcccctgtcagtaggccgcactcatggcatgtggccaagctgctggagggatgccctgaagcagccaccaccatgcatttcccttctgaagccttcagcttgtcctggcattctggctgcaacacaagtgacgtgtgtgtgcagtggtgtccactctcccggcattgcagcaccgagaaaagcagctccattggcagcatggagagcctggagcaaccaggccaagccacctatgagagccatctgttgcctattgaccagaacatgtaccctaaccagcgtgactcagcctacagctccttctcggccagctcaaatgcttctgactgtgccctttccctcaggccagaggagccagcctctacagactgcatcatgcaaggcccagggccaactaaggcccccagtggccggcctaatgtggctgagacctcaggaggtagtcggcgcaccaatgggggccacctgacccccagctctcagatgtcatcccgtccacaggagggataccagtcagggcccgccaaagcagtcaggggcccaccacaacctccagtgaggcgggacagccttcaggcctccagagcccaactcctcaatggagagcagcgcagggcatctgagcctgtggtccccttgccacagaaggagaaactgagcttagagcctgtgctacccgcaaggaaccctaataggttctgttgcctcagtgggcatgaccaagtgacaagtgagggccatcagaactgtgagttcagtcagcctcctgaatccagccaacagggctctgagcatctactgatgcaggcctcaaccaaagctgttggatccccaaaagcctgtgacagagcttccagcggcagacctccacatctcataggacccacagggcatcgccatagtgcccctgaacagctgctggcatcccacctgcagcatgtgcaccttgataccaggggcagcaaagggatggagctcccacccgtacaggatgggcaccagtggactctgtcccctttgcacagcagccacaaagggaagaaaagtccatgcccccctacaggaggaacccatgaccagtccagcaaagaaagaaagaccagacaagtggatgacaggtctttagttttgggacaccagagccaaagcagtcccccacatggagaggctgatggacacccctcagaaaaaggtttcctggacccaaacagaacaagcagagcagccagtgaattggccaaccagcaaccctctgcctctggctcccttgttcaacaagccacggactgttcttcaaccactaaagcagctagtggcacagaggcaggtgaagaaggggacagcgagcccaaggagtgcagccggatgggtggtaggcgaagtggagggacccggggccgctcgatccaaaaccggcggaagagtgagcgttttgctaccaatctgcgtaatgaaattcagaggaggaaggcccagctccagaaaagcaagggtcccttgtcacagctgtgtgacactaaggagccagtggaagagacccaggagcccccagaaagtcctccactcactgcctctaacacatctcttctatcttcatgtaaaaaacctcccagccccagagacaagctcttcaacaaaagcatgatgctcagagctaggtcttccgagtgcctcagccaagcccctgagagccatgaatctaggacaggcttagagggacgaataagccctggccagaggcctggccagtcctctttgggcctgaacacctggtggaaagcacctgacccatcctcctcagaccctgagaaagcacatgctcactgtggagtccgtggaggtcattggagatggtctccagagcataattcacagccacttgtggcagcagccatggaaggcccttccaacccaggtgacaacaaggaattgaaggcttctactgctcaagctggggaggatgccatcctcttgccttttgcagacagaagaaagttctttgaagagagtagcaaatccttatctacatctcatttgccaggtttaaccactcatagcaacaagacttttacccagagaccaaaacctatagaccaaaacttccagccaatgagctccagctgtagggaattgaggcgccatcccatggaccaatcatatcattccgcagaccaaccatatcatgccacagaccaatcatatcattccatgtcaccccttcagtcagaaactcccacttactcagaatgttttgcaagcaaaggtctagaaaattccatgtgttgtaagccactacactgtggtgattttgattaccacaggacctgctcttactcctgcagtgttcaaggagctctagtccatgatccttgcatttattgttctggggaaatctgccctgccttgctaaagagaaatatgatgccaaattgctacaactgccggtgccaccaccaccaatgcattcggtgttcagtttgctatcataatcctcagcacagtgccctcgaggacagcagcttggcacctggcaacacttggaaacccaggaagctgacagtgcaggaatttcctggggacaaatggaatccaataacaggaaacaggaagaccagccagtcagggagggaaatggctcattccaagactagcttttcatgggcaacccctttccatccttgccttgagaacccagcactggacttgtcaagctaccgagcaatttcttctcttgacctccttggagacttcaaacatgctttgaaaaaatcagaggaaacttcagtttatgaggaggggagctcccttgcctccatgccccacccactgcgcagccgtgccttctcagagagtcacatcagcttggcgccccaaagcacccgggcctgggggcagcataggagggagctctttagcaaaggtgatgagacccagtcggatcttctcggagccaggaagaaggcctttcctcctcctcgccctcctcctcccaactgggagaagtacaggctctttcgtgcagcccagcagcagaagcagcaacagcagcagcagaagcaacaggaggaggaggaggaggaggaagaagaagaagaagaggaagaggaagaggaggaggaggaggcagaggaggaggangaggagctgccaccccagtatttcagttcagaaacctctggttcctgtgctctcaatcctgaggaggtcctagagcagccacaacccctcagctttggccacctggagggctcgagacagggttcacaaagtgtcccagcagagcaagaatcctttgcactccattccagtgatttcttgcctccaataaggggtcacttgggatctcaacctgagcaggctcagcccccttgctactatggcattggtgggctttggaggacatcgggacaggaagccactgaatccgccaaacaagagtttcagcacttttcgcctccttcaggggccccaggaatccctacctcttactcagcttattacaatatttctgtggccaaggcagagctgctgaacaaactgaaagaccaacctgagatggcagagattggcctaggagaggaggaagttgaccatgaactggctcaaaaaaagatacagcttatcgaaagcatcagcagaaaactttctgtcttgcgggaggcccagcgagggctgctagaggacatcaatgccaattctgcccttggggaggaggtggaggccaacttaaaagccgtctgcaaatccaatgaatttgaaaagtaccacttgtttgttggggacctggacaaagtggtcaacctgttgctgtcactctctggacgactggcccgggtggagaatgctctgaacagcatcgattcagaggccaaccaggagaagttggtactgatagagaagaagcagcagctgacggggcagttggcagatgccaaggagctgaaggagcacgtggaccgccgggagaagttggtgtttggcatggtctcccgctacctgcctcaggaccagctccaagattaccagcactttgtcaagatgaaatctgctctcatcattgaacagcgagagctggaggagaagatcaagctcggggaagagcaactcaaatgtctcagggagagtctactcctggggcccagcaatttctaattctaccagcactctgccacagcatccctgcccagccatgtgggaagtgctttcaatcttctttgttagcagtttctcagcaagtagatagcaattagcagtttgttccagccctctaccctggatgtctctcactaccccttccctagcagtggtcctaaccagctaggagaccctggggaagccacaagcttctacccaagggagctgcagcaaggtgtgatcttagaaccacactctccttcccacagttgccaagggcaagtacttgctgcacagagaaccaaggaagtgccttcattctgctttgtactaggacaccaaagacatcaagtactcatcacccacccatatcatcaacagcctctaaaggctcagagggaatctgccttgcagctctactctgccccagggcttgtggccagccatttctcacagagagctggctgccttgagggcattcacctggcaccagtttcagggcctcacccaagctttgcaggggaaagcacagagggaggaattacactgaaaaaaatgcaagcaaaggttgagtacccccaggtgccccttaggaaggaaccaggtttaaataggctctacccttacctttcccagcagcaagttcaggggaagaggcctactcttagccctggctagtgtgaccctcttcctgtcctaagactttggtcctaccacctcttgtttcatctttcctttacattgctgggggttaccgcaggtgcctaccccagggcttcaccatatgggccattaatagctctactaaaactgacttctagatgtaggtttcattattgggggagggggttcttattgttatattttaaatggccttttgattttatttatttttatgttttgattatttttttcttttttaactaataaggcgagaagagggaagttggagagggaaaagttagcccagaaggaaagcattttctgcagatcagcctgaatccaccgtggctaggcatattcttgctcttctcgtgttgctcacaactacctgcctggatgaatttaggaaagttgcaggatacaaggttaaaacacaagatcaaatgaacaatccgaaaatgttattaagaaaacagttccggccgggcatggtggctcacgcctgaaatcccagcactttgggaggccgaggcaggtggatcacgaggtcaggagatcaagaccatcctggctaacacggtgaaaccctatctctactaaaaatacaaaaaattagccaggtgtggtggcacgcaccagtagtcccagctactcgggaggctgaggcaggagaattgcttgaacctggaaggcagagattgcagtgagctgagaccacaccactgcactccatcctgggcaacagagtgagactttgtctcaaaaagaaagaaagaaagaaagaaagaaagaaagaaaagaaagaaagaaagaaagaaagaaaacagttccatttacaatagcatc

SEQ ID NO: 72846 - DNA, 6080 bp, Homo sapiens
  misc_feature (33)..(33): n is a, c, g, or t
  misc_feature (3575)..(3575): n is a, c, g, or t
ctttcatccttccctttgccaccagggtgctgnctggttcctggagcagcgtcttcactcctatccagctcttgacactggctttcgttccctaaggctgtggccatatctaggtccatccaggctgatggtcataccttgccttcagtgctactccttcctgttcttagaactggaacctgactgtgcctgagccccttggatcacactcagcatcttgggctgatggtccctcgccccagaaggtcttaactggagggcagatgggtcccagctaagggaggacgctggctggagggtttgtcaacgagagtctgagctagccggataccccgctctctcccaagccatctctccaccctgggcaacttccatggaggaacgcccctgtcagtaggccgcactcatggcatgtggccaagctgctggagggatgccctgaagcagccaccaccatgcatttcccttctgaagccttcagcttgtcctggcattctggctgcaacacaagtgacgtgtgtgtgcagtggtgtccactctcccggcattgcagcaccgagaaaagcagctccattggcagcatggagagcctggagcaaccaggccaagccacctatgagagccatctgttgcctattgaccagaacatgtaccctaaccagcgtgactcagcctacagctccttctcggccagctcaaatgcttctgactgtgccctttccctcaggccagaggagccagcctctacagactgcatcatgcaaggcccagggccaactaaggcccccagtggccggcctaatgtggctgagacctcaggaggtagtcggcgcaccaatgggggccacctgacccccagctctcagatgtcatcccgtccacaggagggataccagtcagggcccgccaaagcagtcaggggcccaccacaacctccagtgaggcgggacagccttcaggcctccagagcccaactcctcaatggagagcagcgcagggcatctgagcctgtggtccccttgccacagaaggagaaactgagcttagagcctgtgctacccgcaaggaaccctaataggttctgttgcctcagtgggcatgaccaagtgacaagtgagggccatcagaactgtgagttcagtcagcctcctgaatccagccaacagggctctgagcatctactgatgcaggcctcaaccaaagctgttggatccccaaaagcctgtgacagagcttccagcgtggattccaacccactcaatgaggcttctgcagagctagctaaggcttcttttggcagacctccacatctcataggacccacagggcatcgccatagtgcccctgaacagctgctggcatcccacctgcagcatgtgcaccttgataccaggggcagcaaagggatggagctcccacccgtacaggatgggcaccagtggactctgtcccctttgcacagcagccacaaagggaagaaaagtccatgcccccctacaggaggaacccatgaccagtccagcaaagaaagaaagaccagacaagtggatgacaggtctttagttttgggacaccagagccaaagcagtcccccacatggagaggctgatggacacccctcagaaaaaggtttcctggacccaaacagaacaagcagagcagccagtgaattggccaaccagcaaccctctgcctctggctcccttgttcaacaagccacggactgttcttcaaccactaaagcagctagtggcacagaggcaggtgaagaaggggacagcgagcccaaggagtgcagccggatgggtggtaggcgaagtggagggacccggggccgctcgatccaaaaccggcggaagagtgagcgttttgctaccaatctgcgtaatgaaattcagaggaggaaggcccagctccagaaaagcaagggtcccttgtcacagctgtgtgacactaaggagccagtggaagagacccaggagcccccagaaagtcctccactcactgcctctaacacatctcttctatcttcatgtaaaaaacctcccagccccagagacaagctcttcaacaaaagcatgatgctcagagctaggtcttccgagtgcctcagccaagcccctgagagccatgaatctaggacaggcttagagggacgaataagccctggccagaggcctggccagtcctctttgggcctgaacacctggtggaaagcacctgacccatcctcctcagaccctgagaaagcacatgctcactgtggagtccgtggaggtcattggagatggtctccagagcataattcacagccacttgtggcagcagccatggaaggcccttccaacccaggtgacaacaaggaattgaaggcttctactgctcaagctggggaggatgccatcctcttgccttttgcagacagaagaaagttctttgaagagagtagcaaatccttatctacatctcatttgccaggtttaaccactcatagcaacaagacttttacccagagaccaaaacctatagaccaaaacttccagccaatgagctccagctgtagggaattgaggcgccatcccatggaccaatcatatcattccgcagaccaaccatatcatgccacagaccaatcatatcattccatgtcaccccttcagtcagaaactcccacttactcagaatgttttgcaagcaaaggtctagaaaattccatgtgttgtaagccactacactgtggtgattttgattaccacaggacctgctcttactcctgcagtgttcaaggagctctagtccatgatccttgcatttattgttctggggaaatctgccctgccttgctaaagagaaatatgatgccaaattgctacaactgccggtgccaccaccaccaatgcattcggtgttcagtttgctatcataatcctcagcacagtgccctcgaggacagcagcttggcacctggcaacacttggaaacccaggaagctgacagtgcaggaatttcctggggacaaatggaatccaataacaggaaacaggaagaccagccagtcagggagggaaatggctcattccaagactagcttttcatgggcaacccctttccatccttgccttgagaacccagcactggacttgtcaagctaccgagcaatttcttctcttgacctccttggagacttcaaacatgctttgaaaaaatcagaggaaacttcagtttatgaggaggggagctcccttgcctccatgccccacccactgcgcagccgtgccttctcagagagtcacatcagcttggcgccccaaagcacccgggcctgggggcagcataggagggagctctttagcaaaggtgatgagacccagtcggatcttctcggagccaggaagaaggcctttcctcctcctcgccctcctcctcccaactgggagaagtacaggctctttcgtgcagcccagcagcagaagcagcaacagcagcagcagaagcaacaggaggaggaggaggaggaggaagaagaagaagaagaggaagaggaagaggaggaggaggaggcagaggaggaggangaggagctgccaccccagtatttcagttcagaaacctctggttcctgtgctctcaatcctgaggaggtcctagagcagccacaacccctcagctttggccacctggagggctcgagacagggttcacaaagtgtcccagcagagcaagaatcctttgcactccattccagtgatttcttgcctccaataaggggtcacttgggatctcaacctgagcaggctcagcccccttgctactatggcattggtgggctttggaggacatcgggacaggaagccactgaatccgccaaacaagagtttcagcacttttcgcctccttcaggggccccaggaatccctacctcttactcagcttattacaatatttctgtggccaaggcagagctgctgaacaaactgaaagaccaacctgagatggcagagattggcctaggagaggaggaagttgaccatgaactggctcaaaaaaagatacagcttatcgaaagcatcagcagaaaactttctgtcttgcgggaggcccagcgagggctgctagaggacatcaatgccaattctgcccttggggaggaggtggaggccaacttaaaagccgtctgcaaatccaatgaatttgaaaagtaccacttgtttgttggggacctggacaaagtggtcaacctgttgctgtcactctctggacgactggcccgggtggagaatgctctgaacagcatcgattcagaggccaaccaggagaagttggtactgatagagaagaagcagcagctgacggggcagttggcagatgccaaggagctgaaggagcacgtggaccgccgggagaagttggtgtttggcatggtctcccgctacctgcctcaggaccagctccaagattaccagcactttgtcaagatgaaatctgctctcatcattgaacagcgagagctggaggagaagatcaagctcggggaagagcaactcaaatgtctcagggagagtctactcctggggcccagcaatttctaattctaccagcactctgccacagcatccctgcccagccatgtgggaagtgctttcaatcttctttgttagcagtttctcagcaagtagatagcaattagcagtttgttccagccctctaccctggatgtctctcactaccccttccctagcagtggtcctaaccagctaggagaccctggggaagccacaagcttctacccaagggagctgcagcaaggtgtgatcttagaaccacactctccttcccacagttgccaagggcaagtacttgctgcacagagaaccaaggaagtgccttcattctgctttgtactaggacaccaaagacatcaagtactcatcacccacccatatcatcaacagcctctaaaggctcagagggaatctgccttgcagctctactctgccccagggcttgtggccagccatttctcacagagagctggctgccttgagggcattcacctggcaccagtttcagggcctcacccaagctttgcaggggaaagcacagagggaggaattacactgaaaaaaatgcaagcaaaggttgagtacccccaggtgccccttaggaaggaaccaggtttaaataggctctacccttacctttcccagcagcaagttcaggggaagaggcctactcttagccctggctagtgtgaccctcttcctgtcctaagactttggtcctaccacctcttgtttcatctttcctttacattgctgggggttaccgcaggtgcctaccccagggcttcaccatatgggccattaatagctctactaaaactgacttctagatgtaggtttcattattgggggagggggttcttattgttatattttaaatggccttttgattttatttatttttatgttttgattatttttttcttttttaactaataaggcgagaagagggaagttggagagggaaaagttagcccagaaggaaagcattttctgcagatcagcctgaatccaccgtggctaggcatattcttgctcttctcgtgttgctcacaactacctgcctggatgaatttaggaaagttgcaggatacaaggttaaaacacaagatcaaatgaacaatccgaaaatgttattaagaaaacagttccggccgggcatggtggctcacgcctgaaatcccagcactttgggaggccgaggcaggtggatcacgaggtcaggagatcaagaccatcctggctaacacggtgaaaccctatctctactaaaaatacaaaaaattagccaggtgtggtggcacgcaccagtagtcccagctactcgggaggctgaggcaggagaattgcttgaacctggaaggcagagattgcagtgagctgagaccacaccactgcactccatcctgggcaacagagtgagactttgtctcaaaaagaaagaaagaaagaaagaaagaaagaaagaaaagaaagaaagaaagaaagaaagaaaacagttccatttacaatagcatc

SEQ ID NO: 72847 - DNA, 306 bp, Homo sapiens
aaatcaatgaacttgggaaggaaaactacttgctacataatccagaaaattttactaaattatttgaactaagcatgactctccaaactgtggacatattttctcaagggattctatgtattatggcttcaaggtacttttgtgtgtacctcaaaatggctgaaggcattttaacagtgcatctgagagtgtcttacttacatattatttgtacactattttatctatatctttggacattttatatttctgtgtaagtaaaacttccatgaaaatttcatttgtcaccatattttcgttatgcag

SEQ ID NO: 72848 - DNA, 1107 bp, Homo sapiens
attagagtctgtgcttcacttccgttccagcctcagcggcagctggatcgctcgacggagtgcctctggtagttggccaagacgccgaatatcaaaatcttcagcggcagctcccaccaggacttatcccagaaaattgctgaccgcctgggcctggagctaggcaaggtggtgactaagaaattcagcaaccaggagacctgcgtggaaattgatgagagtgtgcgtggagaggatgtctacatcgttcagagtggttgtggcgaaatcaacgacagtctaatggagcttttgatcatgattaatgcctgcaagattgcttcagctagccgagttactgcagtcatcccatgcttcccttatgcccgacaggataagaaggataagagccggtccccaatctctgccaagcttgttgcaaatatgctctctatagcaggtgcggatcatatcatcaccatggacctacatgcttctcaaattcagggcttttttgatatcccagtagacaacttgtatgcagagccaactgtcctgaagtggataagggagaatatccctgagtggaagaactgcattattgtctcgccagatgctggtggagctaaaagagtgacctccattgcagaccagttgaatgtggactttgctttgattcataaagaacggaagaaggccaatgaagtggactgcatagtgctagtgggagatgtgaatgatcgtgtggctatccttgtagatgacatggcagacacttgtgttacaatctgcctcgcagctgacaaacttctctcagctggagcaaccagagtttatgctatcttgactcatggaatcttttctggcccagccatttctcgcatcaacactgcatgctttgaagcagtggtagtcaccaataccatacctcaagatgagaagatgaagcattgctccaaaatacgagtaattgacatctccatgatccttgcagaagccataaggagaactcataatggggaatctgtttcctacctgttcagccatgttcctttataacagaataacttctaggttatgctattttaaaataaaataagattaataaaaacaaaccttgcctttatt

SEQ ID NO: 72849 - DNA, 381 bp, Homo sapiens
caacattgtacaattagcttaggttctagaccataataggtgctcaacatttgtgaaatgaatgaatgattgaatagttcaatttaaaaagcagtgaaggggcagggtgtggtggctcaggcctgtaatcccagcacttttggaggccgaggtgggcggatcacctgaagtcagaagtccaagaccagcctgaccaacatggagaaaccccatctctactaaaaatacaaaattagctgggcgtggtggtgcatgactgtaatcctagctactcaggaggctgaggcaggagaattgcttgaacctgggaggcggaggttgcagtgagccgaaattgcaccattgcactccagcctggcaacaaaagtgaaactctgtctc

SEQ ID NO: 72850 - DNA, 584 bp, Homo sapiens
tgctatgctgcccagacaggtcttgaactcctggcctcaagtgatcttctcctcttagcccccaaagacctaggattacaggcatgggctaccatgcctgtctcctgtggtgggtttatatctctgtgttcctttcctgccattttagtggttattgagactgtgtgaagttgcatgctttcatgcaatcactggcttgaacaagaaaccttttttctggggcatttctaattgcttggatatatgcaagtaaacttcttatttagcttatcacatttaatgtgttgacaatgatgggtacaaaatggaacccaataagaaaatcaccgaagtgtttccagtaaaaatgcacaaggatatgctctgacttggatcccattctttcattcaatgtctgtttactgggcacacactgatgctaccccgtgaagtggctgaggcagtgcacatggtaggcatggcccctgccttcctgaagctcatgctatgggaaagccatggtgtagaattatcaagtaagacaggtccagatagtgagaagtacctgtgtggaggacgaggtgccaccttatgaagaggcctgg

SEQ ID NO: 72851 - DNA, 527 bp, Homo sapiens
gctcaaagcaggcctccatcgttttgaatagtatacaaaaaacaacaaggggagctctgtgaagttagaaaaactaccctaattcacctcattctaaaagttgaggaaaactaatttcacataaaaacaataacaggaataacaaggtcaaatcccgtacagtgttacaagaaaaacgagatgcggaaaagaacagcatccctagagacgatgaaatcaagccagaaatatacacctataagacaagtcgaaaattgtaaccttgtatttcaaaatgagctaaaaacaataagatggtataagacatgaaagaaaaacgatcagcattagtaaaactaagaaatgaagctcaggaaaagaattagaaataaaagaaaattatttcagaaatggagactaaagtaggaggaacataaacaacggataatatgttaagaaaaatagaagatgaaaaaaatttaaaaagtgagtcaacctttggacaagagtctgtgaagaaaaccagagcaagggaacagaaaaaatac

SEQ ID NO: 72852 - DNA, 414 bp, Homo sapiens
ctcctaaacaccagtcatctgacatacactgcagatctaaaatgggcctacgtgttctgcccttccttgcctacctgttgagcttgcaccgcttctgtgagtctccccccacccacaagagatccttcttccttcgcgctccactaacccgacataaatgtttatcatataaagttttccgttgcactcttgtgtttatgtctcctggcttcttcaccaagctgtgtgacagctgggccctgtcgcctccttcctcgtatatgcagcgactatcgcagagccgcttaatctttgttgaaggcagctgcggttcagccctgagggccacgggacggacgccactcattcagccctaccgggggcgctgtggcagccggcattggttgccgtgccctccgcttgtctcgctcagct

SEQ ID NO: 72853 - DNA, 414 bp, Homo sapiens
gttcaataatatctattattaaaattaatctcactgttccttttttcctttttaatatggcttctagagaatttaaaattatatatgtgactcacgtatagtacaacactgtaaatctataccatttgatatatacacatatgaccgatgatcattatactactaacaatattataaactaaaacataaactccctctgaattgctacaaaatcttaattaacaagttccaaatcaatgtccacagtagcgctgtagtaactggaaggtctagggcaaatttagtgctgagactgtggcacaaaaacatgtaccttacatcttagcctagaactgcaccttgaggaatttccttagtgggaagtgggttctggtctctctaaaaataatcccactgttcataaaatacttcttt

SEQ ID NO: 72854 - DNA, 427 bp, Homo sapiens
gaaaaatatcaccggtactgtgatagggattacattgagtctataactcactctgggtagtacagacattcaaacaatattaattcttccattccagagcatgggatatctttcatttttttttgtcacctttaatttctttcattggtgtcttatagttttctttgtagagatattttacttctttgttctttagttacatttattcctaggtattttattttttgtagctattgtaaatgagattgatttatttctttttcaggctgattgctgttagcatatagaaacactcctgatttttgcatgctgattttgtgtcctatgattttactaaattcatttgtcggttctaagagtttttggtggagtctttgggcttttctaaatttaagatcatgttgtttgcaaacaaggataacttgac

SEQ ID NO: 72855 - DNA, 249 bp, Homo sapiens
cacctgctgggacatgcgagtgctggtgtctggaaggagggccgggctgtgctgagctctggggggccggtccccacagctcccccgacagggcccccggggcctcctctataaatcaggggtccgtgctcccagcccgcttcgaggggtttctgcttggcgtgtgggttctaagtgcgagctgctgtgtgtggaggctcctgagcaccgggtgcccctcgcgcgtgtgggtcccggggcagcccagct

SEQ ID NO: 72856 - DNA, 248 bp, Homo sapiens
tctgaattctatctcactttattatttcagtgataccaaaagacatcaatgtcacagtagtgatatacttatgtattagttatggaaattccacaggagttcaaggtcattatcactataattattttcctgactaaagccataaaggtgatttaggcaattattgtcatcttagctagtcctgttttatagcttatattcagcagacagctgtatgggaaggtaaatatgttgacaatgtccacaaa

SEQ ID NO: 72857 - DNA, 487 bp, Homo sapiens
attccatgtttattagtctattcaaaagcttttagaaatctgcacagccaagtggcactgaatccagaagcatgaaaggagctgcacaacttttcctcgtaagatttacacaagcagcacgggaaatctgaggcccagacatttccttatcaacagaatactccggtggattttcaagcaggctgttcagcagaggtttcgagcaggagcccaggtgtgggaagagcggagtgtgggagtcctcgtgtgaccctctgggggtggtgatggaactgactgtatggtctgcaaaacctaaaatatttactgtcaggtgcttatgtgtcctgtcctgagcccgtttcctctcttgtaaaatggagcaatgctgcttgatgaaatcagtcaagttgtggttggattcttatatgtaataaacctgcacattgtgcacatataccctaaaacttaaagtatgataaaaataaaaaaaattgttgcaaatctg

SEQ ID NO: 72858 - DNA, 94 bp, Homo sapiens
gatacccctgtcttacacccttcctccctgtgcctcaatcacaggagtcttggtatgtcttgtcaaaagcatcatgctctttctcacctatcct

SEQ ID NO: 72859 - DNA, 1061 bp, Homo sapiens
  misc_feature (18)..(18): n is a, c, g, or t
  misc_feature (880)..(880): n is a, c, g, or t
ccgggagtgcccgttgtntgcctggagacatgcctgtgggagaagaggctgcccccacctgctaccatcatcccagcatgggtgcggtggggggcaggggagacagagtaaaaatcgcagaggacatggggcagaaagatggaaggaacctgggccctcgatggctctgagtgagtcagtcctgcagtgccccgtccccatttttctgtggcctgggaaagtcaaatttcctcatcctttgtagttggccattgtgttatttggagatggaagagcattctgaaacaagccactataatgaaaatccaggtcgtagcaacttgccgtgcacggctttggcttggcatggacttacagtgacatctttgagatgcacttgtccggggtgcaggtatatttgagagtgtgaggaggacatatgtcctctaagctctgttttctaaaggcagcagaattccatttgccaagccagatgtccctcaatacgttagatcccaccaataaaacattaagcaattacaatggttaatattcactaaagtataattagaagctggcgtaaattgtgaatgaaattggcgggttccatacgttacagtgaaataccaaatctttttttagttgtgtatgtgtatctcagtgagtctgtcaactcagatgagtgaatcttacctcctctgtggatagaaacgagctcaatttcaactcagttcactataattttaaatgtttaagaacatcttgccagttgttctatcatgttaaagttactgaaatctggctgggtggagtggctcatgcctgtaatcccaggactttgggaggctgaggcgggtggattgcttgagcccaggagttcaagaccagcctgggcaacatngtgagaccctctctacaaaaaaaatccaaaagtagctgggcatcatggtgacgcacacctgtgttcccagctactcaggaggctgaggtgggaggatcacttgaagccgggaggtcgaaggtgcagggagccatgatcgtgacactgcattccagcctgggtgacagaacgagaccctgtc

SEQ ID NO: 72860 - DNA, 1515 bp, Homo sapiens
  misc_feature (1)..(1): n is a, c, g, or t
  misc_feature (170)..(170): n is a, c, g, or t
  misc_feature (559)..(559): n is a, c, g, or t
ngctactcgggaggctgagtcaggagaatggtgtgaacctgggaggcagagcttgcagtgagccgagatcgcgccactgcactccagcctgggcgacagagcaaggctctgtctcaaaaaaaaaaaaaaaaagaaaaagaaaaagaacagggcagggagtttccgtggcnctgaactctataaggctaatgacacaggtcaatagctgaggtgatgaacaatggactcgagatctcagtgaggtcaaagaactgctggataattgagctggacaggttggccaggtcttcccctggaaaggtacacctggctgggagtagacaaacacagggtggggtggaaaaggcaggagaaggaaaggctgagaagtgttagtggcagtatctgccacacccttaccctggtcttctgatcgctccatctgccgcccagcagcctcaaatccaggtctctgggtcctgggtggacctctagttgggagctgataagagaaggaggataggctgggcacggtgcctcatgccggtaatcccagcactttgggaggctgaggcgggcngatcactagaggtcaggagtttgataccagcctggccaacatggtgaagccccatcacatggtgaagccccatcacaccacttcactccagcctgggtgacagagtgaaactccatctcaaaaaaaaaaaaaaaaaaaaaaaatgaggttaaaccacataggggtcttattaggaggcaagggcaagatttggaggtggagagaagaactaccaccactatcactaacatctggtttttgtttttttttttttaccgggagtgcattaggagctgccaatggggctggggcatagaggtgagtgcagattgagggagaggggctccacagaacagccacaaagggaggatgacagtgggatgacacacagcaggcagcaacatggagagtgatccgcaatcaatctcactactcagaagtgaggagctttgctctccaaaaggagtgttagctgggaccagcgccagccctattggtgagagggcagggcttgatttccctcagccatagtccctttatgtctctgcacatttgcccacacagtctccaagacctaggatgcccacccccaatccctatccctccctgcccttcctttgcagatgcggatctccccttggtcattcaaggcactgctcaggcatcttatgcaagaaggcttcccaggttgcgaaggtgactcagacgcctcctttgggactccaacacccttccccggcagagcccctgcctgtctgcctccgtggtgtcaggttttgtgccctctactcactagattgtggacacagaaagcgctggtgctgtcaaaaccacttctgggttgccgggcgcggtggctcacacctataatcccagcactttgggaggccaagatgggcggattgcttgagcccaggagttcaagactaatctggcctacatggtgagaccctgtctctataaaaaatgcaaaaatt

SEQ ID NO: 72861 - DNA, 637 bp, Homo sapiens
aataagagctctgaagataaaaaaccttggtctccacaacctttatcgtaacccagacaatcctttctattcattccaggtctctacaataataacttaactctttcaattaattgcccatcagaaaatcgttgaatccatctgtgacctggacaccttccacctgcatccatggagttgtgtcacctttctggaccaaaccactggacaccttacatgtatcgattggcaacatgtacacctccacacactgctaaatgacaaagccgaattttgaaatacgatactgtgaggtgtttggagaagagaactgaaatgacgtcatggaggtggcaggggatcatcttgcccttttcttattttctgcctgtaacttctgtccccctaaaatgcataaaatccagctagaacccaaccaccttatgcagcagttcttaggacctcatggggctgtgtcatcaatcaaagtcctcatatttggctcagaataaatctcatcaactaatttacaaatttgacatgtgttgacaagtctgtcttaccgttctttaataagggccgtgtataatgttttctttagcaagtgtggcaaaattaaaccttagaaataaagagaaaaagaactcattatagaaaa

SEQ ID NO: 72862 - DNA, 446 bp, Homo sapiens
tttaggcaggagttagaacagttcagcttgggccatgttaagtttcagatgaaacatctgagaaaagatactgagataatttcttagtgaagtctggagttcaaaggagtatctggtttggatatatacattgggcattgccaacatccataaatggtgttcaagccatgagattggcttgagatcaccacgagggtaagtgtgacggaaatgctcaaggcttgagagctttctgatgtgttccaccatgaagaaactggggagatgtggaagaacctccaaaagagactgagaaggagaggccagtaaagtagaaggagtgctgggcagggatgttctggaagccaggtgagaaaatgtcgcaaggaggtagtgatcacctgcgtcacgtggtactagtgggtcaagtaagttgagggccaagacttagccactggatttagcga

SEQ ID NO: 72863 - DNA, 342 bp, Homo sapiens
gcggccgcctactactactactgctcgaattcaagcttctaacgatgtacgggcccatgttgatgcccagggtcactcttgctacccgctgggcccccaaacccccgctgcctctcttccttccccccatcccccacctggttttgactaatcctgcttccctctctgggcctggctgccgggatctggggtccctaagtccctctctttaaagaacttctgcgggtcagactctgaagccgagttgctgtgggcgtgcccggaagcagagcgccacactcgctgcttaagctcccccagctctttccagaaaacattaaactcagaattgtgttttcagca

SEQ ID NO: 72864 - DNA, 616 bp, Homo sapiens
aaacaaaaacgtctggctaggtacgaggctgggtggtttaatcggccgaggagctgcgtcgcctctggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcatatactgcaatcgagcaaggaagaaaatgagaaacagaaacgcgacaaagaggacaaccag

SEQ ID NO: 72865 - DNA, 456 bp, Homo sapiens
cggggcacacacggttaatcctccgcggctgctgtttggacgaaaagcgctgggggtgttggaggctcctcgctgctcacatctggctgggcttcgctccttgcgcgtctgtcccactttctccctctcttcctttactttcgagaaaccgcgcttccgcttctggtcgcagagacctcggagaccgcgccggggagacggaggtgctgtgggtgggggggacctgtggctgctcgtaccgccccccaccctcctcttctgcactgccgtcctccggaagaccttttcccctgctctgtttccttcaccgagtctgtgcatcgccccggacctggccgggaggaggcttggccggcgggagatgctctaggggcggcgcgggaggagcggccggcgggacggaggtaggtggccgggccgggggacccagcgctgccccgccccatcctcgtggct

SEQ ID NO: 72866 - DNA, 443 bp, Homo sapiens
cggggcacacacggttaatcctccgcggctgctgtttggacgaaaagcgctgggggtgttggaggctcctcgctgctcacatctggctgggcttcgctccttgcgcgtctgtcccactttctccctctcttcctttactttcgagaaaccgcgcttccgcttctggtcgcagagacctcggagaccgcgccggggagacggaggtgctgtgggtgggggggacctgtggctgctcgtaccgccccccaccctcctcttctgcactgccgtcctccggaagaccttttcccctgctctgtttccctctctttaaagaacttctgcgggtcagactctgaagccgagttgctgtgggcgtgcccggaagcagagcgccacactcgctgcttaagctcccccagctctttccagaaaacattaaactcagaattgtgttttcagca

SEQ ID NO: 72867 - DNA, 2964 bp, Homo sapiens
cggggcacacacggttaatcctccgcggctgctgtttggacgaaaagcgctgggggtgttggaggctcctcgctgctcacatctggctgggcttcgctccttgcgcgtctgtcccactttctccctctcttcctttactttcgagaaaccgcgcttccgcttctggtcgcagagacctcggagaccgcgccggggagacggaggtgctgtgggtgggggggacctgtggctgctcgtaccgccccccaccctcctcttctgcactgccgtcctccggaagaccttttcccctgctctgtttccttcaccgagtctgtgcatcgccccggacctggccgggaggaggcttggccggcgggagatgctctaggggcggcgcgggaggagcggccggcgggacggagggcccggcaggaagatgggctcccgtggacagggactcttgctggcgtactgcctgctccttgcctttgcctctggcctggtcctgagtcgtgtgccccatgtccagggggaacagcaggagtgggaggggactgaggagctgccgtcgcctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcgggtggcggcagggcgtcccagggtgcggcaccgcggctccagtccttggaaataattaggcaaattctaaaggtctcaaaaggagcaaagtaaaccgtggaggacaaagaaaagggttgttatttttgtctttccagccagcctgctggctcccaagagagaggccttttcagttgagactctgcttaagagaagatccaaagttaaagctctggggtcaggggaggggccgggggcaggaaactacctctggcttaattcttttaagccacgtaggaactttcttgagggataggtggaccctgacatccctgtggccttgcccaagggctctgctggtctttctgagtcacagctgcgaggtgatgggggctggggccccaggcgtcagcctcccagagggacagctgagccccctgccttggctccaggttggtagaagcagccgaagggctcctgacagtggccagggacccctgggtcccccaggcctgcagatgtttctatgaggggcagagctcctggtacatccatgtgtggctctgctccacccctgtgccaccccagagccctggggggtggtctccatgcctgccaccctggcatcggctttctgtgccgcctcccacacaaatcagccccagaaggccccggggccttggcttctgttttttataaaacacctcaagcagcactgcagtctcccatctcctcgtgggctaagcatcaccgcttccacgtgtgttgtgttggttggcagcaaggctgatccagaccccttctgcccccactgccctcatccaggcctctgaccagtagcctgagaggggctttttctaggcttcagagcaggggagagctggaaggggctagaaagctcccgcttgtctgtttctcaggctcctgtgagcctcagtcctgagaccagagtcaagaggaagtacacgtcccaatcacccgtgtcaggattcactctcaggagctgggtggcaggagaggcaatagcccctgtggcaattgcaggaccagctggagcagggttgcggtgtctccacggtgctctcgccctgcccatggccaccccagactctgatctccaggaaccccatagcccctctccacctcaccccatgttgatgcccagggtcactcttgctacccgctgggcccccaaacccccgctgcctctcttccttccccccatcccccacctggttttgactaatcctgcttccctctctgggcctggctgccgggatctggggtccctaagtccctctctttaaagaacttctgcgggtcagactctgaagccgagttgctgtgggcgtgcccggaagcagagcgccacactcgctgcttaagctcccccagctctttccagaaaacattaaactcagaattgtgttttcagca

SEQ ID NO: 72868 - DNA, 2602 bp, Homo sapiens
gcctgggcaaaaatttacactgagtcccactcttcgctccagggcccggcaggaagatgggctcccgtggacagggactcttgctggcgtactgcctgctccttgcctttgcctctggcctggtcctgagtcgtgtgccccatgtccagggggaacagcaggagtgggaggggactgaggagctgccgtcgcctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcgggtggcggcagggcgtcccagggtgcggcaccgcggctccagtccttggaaataattaggcaaattctaaaggtctcaaaaggagcaaagtaaaccgtggaggacaaagaaaagggttgttatttttgtctttccagccagcctgctggctcccaagagagaggccttttcagttgagactctgcttaagagaagatccaaagttaaagctctggggtcaggggaggggccgggggcaggaaactacctctggcttaattcttttaagccacgtaggaactttcttgagggataggtggaccctgacatccctgtggccttgcccaagggctctgctggtctttctgagtcacagctgcgaggtgatgggggctggggccccaggcgtcagcctcccagagggacagctgagccccctgccttggctccaggttggtagaagcagccgaagggctcctgacagtggccagggacccctgggtcccccaggcctgcagatgtttctatgaggggcagagctcctggtacatccatgtgtggctctgctccacccctgtgccaccccagagccctggggggtggtctccatgcctgccaccctggcatcggctttctgtgccgcctcccacacaaatcagccccagaaggccccggggccttggcttctgttttttataaaacacctcaagcagcactgcagtctcccatctcctcgtgggctaagcatcaccgcttccacgtgtgttgtgttggttggcagcaaggctgatccagaccccttctgcccccactgccctcatccaggcctctgaccagtagcctgagaggggctttttctaggcttcagagcaggggagagctggaaggggctagaaagctcccgcttgtctgtttctcaggctcctgtgagcctcagtcctgagaccagagtcaagaggaagtacacgtcccaatcacccgtgtcaggattcactctcaggagctgggtggcaggagaggcaatagcccctgtggcaattgcaggaccagctggagcagggttgcggtgtctccacggtgctctcgccctgcccatggccaccccagactctgatctccaggaaccccatagcccctctccacctcaccccatgttgatgcccagggtcactcttgctacccgctgggcccccaaacccccgctgcctctcttccttccccccatcccccacctggttttgactaatcctgcttccctctctgggcctggctgccgggatctggggtccctaagtccctctctttaaagaacttctgcgggtcagactctgaagccgagttgctgtgggcgtgcccggaagcagagcgccacactcgctgcttaagctcccccagctctttccagaaaacattaaactcagaattgtgttttcagca

SEQ ID NO: 72869 - DNA, 2593 bp, Homo sapiens
cggggcacacacggttaatcctccgcggctgctgtttggacgaaaagcgctgggggtgttggaggctcctcgctgctcacatctggctgggcttcgctccttgcgcgtctgtcccactttctccctctcttcctttactttcgagaaaccgcgcttccgcttctggtcgcagagacctcggagaccgcgccggggagacggaggtgctgtgggtgggggggacctgtggctgctcgtaccgccccccaccctcctcttctgcactgccgtcctccggaagaccttttcccctgctctgtttccttcaccgagtctgtgcatcgccccggacctggccgggaggaggcttggccggcgggagatgctctaggggcggcgcgggaggagcggccggcgggacggagggcccggcaggaagatgggctcccgtggacagggactcttgctggcgtactgcctgctccttgcctttgcctctggcctggtcctgagtcgtgtgccccatgtccagggggaacagcaggagtgggaggggactgaggagctgccgtcgcctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccggctctgctggtctttctgagtcacagctgcgaggtgatgggggctggggccccaggcgtcagcctcccagagggacagctgagccccctgccttggctccaggttggtagaagcagccgaagggctcctgacagtggccagggacccctgggtcccccaggcctgcagatgtttctatgaggggcagagctcctggtacatccatgtgtggctctgctccacccctgtgccaccccagagccctggggggtggtctccatgcctgccaccctggcatcggctttctgtgccgcctcccacacaaatcagccccagaaggccccggggccttggcttctgttttttataaaacacctcaagcagcactgcagtctcccatctcctcgtgggctaagcatcaccgcttccacgtgtgttgtgttggttggcagcaaggctgatccagaccccttctgcccccactgccctcatccaggcctctgaccagtagcctgagaggggctttttctaggcttcagagcaggggagagctggaaggggctagaaagctcccgcttgtctgtttctcaggctcctgtgagcctcagtcctgagaccagagtcaagaggaagtacacgtcccaatcacccgtgtcaggattcactctcaggagctgggtggcaggagaggcaatagcccctgtggcaattgcaggaccagctggagcagggttgcggtgtctccacggtgctctcgccctgcccatggccaccccagactctgatctccaggaaccccatagcccctctccacctcaccccatgttgatgcccagggtcactcttgctacccgctgggcccccaaacccccgctgcctctcttccttccccccatcccccacctggttttgactaatcctgcttccctctctgggcctggctgccgggatctggggtccctaagtccctctctttaaagaacttctgcgggtcagactctgaagccgagttgctgtgggcgtgcccggaagcagagcgccacactcgctgcttaagctcccccagctctttccagaaaacattaaactcagaattgtgttttcagca

SEQ ID NO: 72870 - DNA, 2910 bp, Homo sapiens
cggggcacacacggttaatcctccgcggctgctgtttggacgaaaagcgctgggggtgttggaggctcctcgctgctcacatctggctgggcttcgctccttgcgcgtctgtcccactttctccctctcttcctttactttcgagaaaccgcgcttccgcttctggtcgcagagacctcggagaccgcgccggggagacggaggtgctgtgggtgggggggacctgtggctgctcgtaccgccccccaccctcctcttctgcactgccgtcctccggaagaccttttcccctgctctgtttccttcaccgagtctgtgcatcgccccggacctggccgggaggaggcttggccggcgggagatgctctaggggcggcgcgggaggagcggccggcgggacggagggcccggcaggaagatgggctcccgtggacagggactcttgctggcgtactgcctgctccttgcctttgcctctggcctggtcctgagtcgtgtgccccatgtccagggggaacagcaggagtgggaggggactgaggagctgccgtcgcctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcgggtggcggcagggcgtcccagggtgcggcaccgcggctccagtccttggaaataattaggcaaattctaaaggtctcaaaaggagcaaagtaaaccgtggaggacaaagaaaagggttgttatttttgtctttccagccagcctgctggctcccaagagagaggccttttcagttgagactctgcttaagagaagatccaaagttaaagctctggggtcaggggaggggccgggggcaggaaactacctctggcttaattcttttaagccacgtaggaactttcttgagggataggtggaccctgacatccctgtggccttgcccaagggctctgctggtctttctgagtcacagctgcgaggtgatgggggctggggccccaggcgtcagcctcccagagggacagctgagccccctgccttggctccaggttggtagaagcagccgaagggctcctgacagtggccagggacccctgggtcccccaggcctgcagatgtttctatgaggggcagagctcctggtacatccatgtgtggctctgctccacccctgtgccaccccagagccctggggggtggtctccatgcctgccaccctggcatcggctttctgtgccgcctcccacacaaatcagccccagaaggccccggggccttggcttctgttttttatcgcttccacgtgtgttgtgttggttggcagcaaggctgatccagaccccttctgcccccactgccctcatccaggcctctgaccagtagcctgagaggggctttttctaggcttcagagcaggggagagctggaaggggctagaaagctcccgcttgtctgtttctcaggctcctgtgagcctcagtcctgagaccagagtcaagaggaagtacacgtcccaatcacccgtgtcaggattcactctcaggagctgggtggcaggagaggcaatagcccctgtggcaattgcaggaccagctggagcagggttgcggtgtctccacggtgctctcgccctgcccatggccaccccagactctgatctccaggaaccccatagcccctctccacctcaccccatgttgatgcccagggtcactcttgctacccgctgggcccccaaacccccgctgcctctcttccttccccccatcccccacctggttttgactaatcctgcttccctctctgggcctggctgccgggatctggggtccctaagtccctctctttaaagaacttctgcgggtcagactctgaagccgagttgctgtgggcgtgcccggaagcagagcgccacactcgctgcttaagctcccccagctctttccagaaaacattaaactcagaattgtgttttcagca

SEQ ID NO: 72871 - DNA, 2866 bp, Homo sapiens
cggggcacacacggttaatcctccgcggctgctgtttggacgaaaagcgctgggggtgttggaggctcctcgctgctcacatctggctgggcttcgctccttgcgcgtctgtcccactttctccctctcttcctttactttcgagaaaccgcgcttccgcttctggtcgcagagacctcggagaccgcgccggggagacggaggtgctgtgggtgggggggacctgtggctgctcgtaccgccccccaccctcctcttctgcactgccgtcctccggaagaccttttcccctgctctgtttccttcaccgagtctgtgcatcgccccggacctggccgggaggaggcttggccggcgggagatgctctaggggcggcgcgggaggagcggccggcgggacggagggcccggcaggaagatgggctcccgtggacagggactcttgctggcgtactgcctgctccttgcctttgcctctggcctggtcctgagtcgtgtgccccatgtccagggggaacagcaggagtgggaggggactgaggagctgccgtcgcctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcgggtggcggcagggcgtcccagggtgcggcaccgcggctccagtccttggaaataattaggcaaattctaaaggtctcaaaaggagcaaagtaaaccgtggaggacaaagaaaagggttgttatttttgtctttccagccagcctgctggctcccaagagagaggccttttcagttgagactctgcttaagagaagatccaaagttaaagctctggggtcaggggaggggccgggggcaggaaactacctctggcttaattcttttaagccacgtaggaactttcttgagggataggtggaccctgacatccctgtggccttgcccaagggctctgctggtctttctgagtcacagctgcgaggtgatgggggctggggccccaggcgtcagcctcccagagggacagctgagccccctgccttggctccaggttggtagaagcagccgaagggctcctgacagtggccagggacccctgggtcccccaggcctgcagatgtttctatgaggggcagagctcctggtacatccatgtgtggctctgctccacccctgtgccttggcttctgttttttataaaacacctcaagcagcactgcagtctcccatctcctcgtgggctaagcatcaccgcttccacgtgtgttgtgttggttggcagcaaggctgatccagaccccttctgcccccactgccctcatccaggcctctgaccagtagcctgagaggggctttttctaggcttcagagcaggggagagctggaaggggctagaaagctcccgcttgtctgtttctcaggctcctgtgagcctcagtcctgagaccagagtcaagaggaagtacacgtcccaatcacccgtgtcaggattcactctcaggagctgggtggcaggagaggcaatagcccctgtggcaattgcaggaccagctggagcagggttgcggtgtctccacggtgctctcgccctgcccatggccaccccagactctgatctccaggaaccccatagcccctctccacctcaccccatgttgatgcccagggtcactcttgctacccgctgggcccccaaacccccgctgcctctcttccttccccccatcccccacctggttttgactaatcctgcttccctctctgggcctggctgccgggatctggggtccctaagtccctctctttaaagaacttctgcgggtcagactctgaagccgagttgctgtgggcgtgcccggaagcagagcgccacactcgctgcttaagctcccccagctctttccagaaaacattaaactcagaattgtgttttcagca

SEQ ID NO: 72872 - DNA, 1827 bp, Homo sapiens
ggctttccagaaggaaaaaaaaattattgcttctgggcgaaaatagaaccatccttgaggttgagtctgtttgcttggccattttgggaatcacaatacctctgtgccaggctgggacgccgcccgtggcagggggctgggggcaggagtgaagcttctgccaggtcagggctgtgctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcgggtggcggcagggcgtcccagggtgcggcaccgcggctccagtccttggaaataattaggcaaattctaaaggtctcaaaaggagcaaagtaaaccgtggaggacaaagaaaagggttgttatttttgtctttccagccagcctgctggctcccaagagagaggccttttcagttgagactctgcttaagagaagatccaaagttaaagctctggggtcaggggaggggccgggggcaggaaactacctctggcttaattcttttaagccacgtaggaactttcttgagggataggtggaccctgacatccctgtggccttgcccaagggctctgctggtctttctgagtcacagctgcgaggtgatgggggctggggccccaggcgtcagcctcccagagggacagctgagccccctgccttggctccaggttggtagaagcagccgaagggctcctgacagtggccagggacccctgggtcccccaggcctgcagatgtttctatgaggggcagagctcctggtacatccatgtgtggctctgctccacccctgtgccaccccagagccctggggggtggtctccatgcctgccaccctggcatcggctttctgtgccgcctcccacacaaatcagccccagaaggccccggggccttggcttctgttttttataaaacacctcaagcagcactgcagtctcccatctcctcgtgggctaagcatcaccgcttccacgtgtgttgtgttggttggcagcaaggctgatccagaccccttctgcccccactgccctcatccaggcctctgaccagtagcctgagaggggctttttctaggcttcagagcaggggagagctggaaggggctagaaagctcccgcttgtctgtttctcaggctcctgtgagcctcagtcctgagaccagagtcaagaggaagtacacgtcccaatcacccgtgtcaggattcactctcaggagctgggtggcaggagaggcaatagcccctgtggcaattgcaggaccagctggagcagggttgcggtgtctccacggtgctctcgccctgcccatggccaccccagactctgatctccaggaaccccatagcccctctccacctcaccccatgttgatgcccagggtcactcttgctacccgctgggcccccaaacccccgctgcctctcttccttccccccatcccccacctggttttgactaatcctgcttccctctctgggcctggctgccgggatctggggtccctaagtccctctctttaaagaacttctgcgggtcagactctgaagccgagttgctgtgggcgtgcccggaagcagagcgccacactcgctgcttaagctcccccagctctttccagaaaacattaaactcagaattgtgttttcagca

SEQ ID NO: 72873 - DNA, 1645 bp, Homo sapiens
gccaccttccacccctgcgctgtgctgaccccagggctcagcaccaggctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcgggtggcggcagggcgtcccagggtgcggcaccgcggctccagtccttggaaataattaggcaaattctaaaggtctcaaaaggagcaaagtaaaccgtggaggacagaggccttttcagttgagactctgcttaagagaagatccaaagttaaagctctggggtcaggggaggggccgggggcaggaaactacctctggcttaattcttttaagccacgtaggaactttcttgagggataggtggaccctgacatccctgtggccttgcccaagggctctgctggtctttctgagtcacagctgcgaggtgatgggggctggggccccaggcgtcagcctcccagagggacagctgagccccctgccttggctccaggttggtagaagcagccgaagggctcctgacagtggccagggacccctgggtcccccaggcctgcagatgtttctatgaggggcagagctcctggtacatccatgtgtggctctgctccacccctgtgccaccccagagccctggggggtggtctccatgcctgccaccctggcatcggctttctgtgccgcctcccacacaaatcagccccagaaggccccggggccttggcttctgttttttataaaacacctcaagcagcactgcagtctcccatctcctcgtgggctaagcatcaccgcttccacgtgtgttgtgttggttggcagcaaggctgatccagaccccttctgcccccactgccctcatccaggcctctgaccagtagcctgagaggggctttttctaggcttcagagcaggggagagctggaaggggctagaaagctcccgcttgtctgtttctcaggctcctgtgagcctcagtcctgagaccagagtcaagaggaagtacacgtcccaatcacccgtgtcaggattcactctcaggagctgggtggcaggagaggcaatagcccctgtggcaattgcaggaccagctggagcagggttgcggtgtctccacggtgctctcgccctgcccatggccaccccagactctgatctccaggaaccccatagcccctctccacctcaccccatgttgatgcccagggtcactcttgctacccgctgggcccccaaacccccgctgcctctcttccttccccccatcccccacctggttttgactaatcctgcttccctctctgggcctggctgccgggatctggggtccctaagtccctctctttaaagaacttctgcgggtcagactctgaagccgagttgctgtgggcgtgcccggaagcagagcgccacactcgctgcttaagctcccccagctctttccagaaaacattaaactcagaattgtgttttcagca

SEQ ID NO: 72874 - DNA, 1276 bp, Homo sapiens
cgaaaaggcggcgtagtggctcttgcaccgctccccaggggcccccatggagcccttctgccctttgggtccagtgtggcccctggccccaaagggcaggaaactacctctggcttaattcttttaagccacgtaggaactttcttgagggataggtggaccctgacatccctgtggccttgcccaagggctctgctggtctttctgagtcacagctgcgaggtgatgggggctggggccccaggcgtcagcctcccagagggacagctgagccccctgccttggctccaggttggtagaagcagccgaagggctcctgacagtggccagggacccctgggtcccccaggcctgcagatgtttctatgaggggcagagctcctggtacatccatgtgtggctctgctccacccctgtgccaccccagagccctggggggtggtctccatgcctgccaccctggcatcggctttctgtgccgcctcccacacaaatcagccccagaaggccccggggccttggcttctgttttttataaaacacctcaagcagcactgcagtctcccatctcctcgtgggctaagcatcaccgcttccacgtgtgttgtgttggttggcagcaaggctgatccagaccccttctgcccccactgccctcatccaggcctctgaccagtagcctgagaggggctttttctaggcttcagagcaggggagagctggaaggggctagaaagctcccgcttgtctgtttctcaggctcctgtgagcctcagtcctgagaccagagtcaagaggaagtacacgtcccaatcacccgtgtcaggattcactctcaggagctgggtggcaggagaggcaatagcccctgtggcaattgcaggaccagctggagcagggttgcggtgtctccacggtgctctcgccctgcccatggccaccccagactctgatctccaggaaccccatagcccctctccacctcaccccatgttgatgcccagggtcactcttgctacccgctgggcccccaaacccccgctgcctctcttccttccccccatcccccacctggttttgactaatcctgcttccctctctgggcctggctgccgggatctggggtccctaagtccctctctttaaagaacttctgcgggtcagactctgaagccgagttgctgtgggcgtgcccggaagcagagcgccacactcgctgcttaagctcccccagctctttccagaaaacattaaactcagaattgtgttttcagca

SEQ ID NO: 72875 - DNA, 2906 bp, Homo sapiens
cggggcacacacggttaatcctccgcggctgctgtttggacgaaaagcgctgggggtgttggaggctcctcgctgctcacatctggctgggcttcgctccttgcgcgtctgtcccactttctccctctcttcctttactttcgagaaaccgcgcttccgcttctggtcgcagagacctcggagaccgcgccggggagacggaggtgctgtgggtgggggggacctgtggctgctcgtaccgccccccaccctcctcttctgcactgccgtcctccggaagaccttttcccctgctctgtttccttcaccgagtctgtgcatcgccccggacctggccgggaggaggcttggccggcgggagatgctctaggggcggcgcgggaggagcggccggcgggacggagggcccggcaggaagatgggctcccgtggacagggactcttgctggcgtactgcctgctccttgcctttgcctctggcctggtcctgagtcgtgtgccccatgtccagggggaacagcaggagtgggaggggactgaggagctgccgtcgcctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcgggtggcggcagggcgtcccagggtgcggcaccgcggctccagtccttggaaataattaggcaaattctaaaggtctcaaaaggagcaaagtaaaccgtggaggacaaagaaaagggttgttatttttgtctttccagccagcctgctggctcccaagagagaggccttttcagttgagactctgcttaagagaagatccaaagttaaagctctggggtcaggggaggggccgggggcaggaaactacctctggcttaattcttttaagccacgtaggaactttcttgagggataggtggaccctgacatccctgtggccttgcccaagggctctgctggtctttctgagtcacagctgcgaggtgatgggggctggggccccaggcgtcagcctcccagagggacagctgagccccctgccttggctccaggttggtagaagcagccgaagggctcctgacagtggccagggacccctgggtcccccaggcctgcagatgtttctatgaggggcagagctcctggtacatccatgtgtggctctgctccacccctgtgccaccccagagccctggggggtggtctccatgcctgccaccctggcatcggctttctgtgccgcctcccacacaaatcagccccagaaggccccggggccttggcttctgttttttataaaacacctcaagcagcactgcagtctcccatctcctcgtgggctaagcatcaccgcttccacgtgtgttgtgttggttggcagcaaggctgatccagaccccttctgcccccactgccctcatccaggcctctgaccagtagcctgagaggggctttttctaggcttcagagcaggggagagctggaaggggctagaaagctcccgcttgtctgtttctcaggctcctgtgagcctcagtcctgagaccagagtcaagaggaagtacacgtcccaatcacccgtgtcaggattcactctcaggagctgggtggcaggagaggcaatagcccctgtggcaattgcaggaccaactctgatctccaggaaccccatagcccctctccacctcaccccatgttgatgcccagggtcactcttgctacccgctgggcccccaaacccccgctgcctctcttccttccccccatcccccacctggttttgactaatcctgcttccctctctgggcctggctgccgggatctggggtccctaagtccctctctttaaagaacttctgcgggtcagactctgaagccgagttgctgtgggcgtgcccggaagcagagcgccacactcgctgcttaagctcccccagctctttccagaaaacattaaactcagaattgtgttttcagca

SEQ ID NO: 72876 - DNA, 1059 bp, Homo sapiens
ggagagccgaaagctatcggctaggtacgaggcctgggtggtcctgacatccctgtggccttgcccaagggctctgctggtctttctgagtcacagctgcgaggtgatgggggctggggccccaggcgtcagcctcccagagggacagctgagccccctgccttggctccaggttggtagaagcagccgaagggctcctgacagtggccagggacccctgggtcccccaggcctgcagatgtttctatgaggggcagagctcctggtacatccatgtgtggctctgctccacccctgtgccttggcttctgttttttataaaacacctcaagcagcactgcagtctcccatctcctcgtgggctaagcatcaccgcttccacgtgtgttgtgttggttggcagcaaggctgatccagaccccttctgcccccactgccctcatccaggcctctgaccagtagcctgagaggggctttttctaggcttcagagcaggggagagctggaaggggctagaaagctcccgcttgtctgtttctcaggctcctgtgagcctcagtcctgagaccagagtcaagaggaagtacacgtcccaatcacccgtgtcaggattcactctcaggagctgggtggcaggagaggcaatagcccctgtggcaattgcaggaccagctggagcagggttgcggtgtctccacggtgctctcgccctgcccatggccaccccagactctgatctccaggaaccccatagcccctctccacctcaccccatgttgatgcccagggtcactcttgctacccgctgggcccccaaacccccgctgcctctcttccttccccccatcccccacctggttttgactaatcctgcttccctctctgggcctggctgccgggatctggggtccctaagtccctctctttaaagaacttctgcgggtcagactctgaagccgagttgctgtgggcgtgcccggaagcagagcgccacactcgctgcttaagctcccccagctctttccagaaaacattaaactcagaattgtgttttcagca

SEQ ID NO: 72877 - DNA, 2693 bp, Homo sapiens
cggggcacacacggttaatcctccgcggctgctgtttggacgaaaagcgctgggggtgttggaggctcctcgctgctcacatctggctgggcttcgctccttgcgcgtctgtcccactttctccctctcttcctttactttcgagaaaccgcgcttccgcttctggtcgcagagacctcggagaccgcgccggggagacggaggtgctgtgggtgggggggacctgtggctgctcgtaccgccccccaccctcctcttctgcactgccgtcctccggaagaccttttcccctgctctgtttccttcaccgagtctgtgcatcgccccggacctggccgggaggaggcttggccggcgggagatgctctaggggcggcgcgggaggagcggccggcgggacggagggcccggcaggaagatgggctcccgtggacagggactcttgctggcgtactgcctgctccttgcctttgcctctggcctggtcctgagtcgtgtgccccatgtccagggggaacagcaggagtgggaggggactgaggagctgccgtcgcctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcgggtggcggcagggcgtcccagggtgcggcaccgcggctccagtccttggaaataattaggcaaattctaaaggtctcaaaaggagcaaagtaaaccgtggaggacaaagaaaagggttgttatttttgtctttccagccagcctgctggctcccaagagagaggccttttcagttgagactctgcttaagagaagatccaaagttaaagctctggggtcaggggaggggccgggggcaggaaactacctctggcttaattcttttaagccacgtaggaactttcttgagggataggtggaccctgacatccctgtggccttgcccaagggctctgctggtctttctgagtcacagctgcgaggtgatgggggctggggccccaggcgtcagcctcccagagggacagctgagccccctgccttggctccaggttggtagaagcagccgaagggctcctgacagtggccagggacccctgggtcccccaggcctgcagatgtttctatgaggggcagagctcctggtacatccatgtgtggctctgctccacccctgtgccaccccagagccctggggggtggtctccatgcctgccaccctggcatcggctttctgtgccgcctcccacacaaatcagccccagaaggccccggggccttggcttctgttttttataaaacacctcaagcagcactgcagtctcccatctcctcgtgggctaagcatcaccgcttccacgtgtgttgtgttggttggcagcaaggctgatccagaccccttctgcccccactgccctcatccaggcctctgaccagtagcctgagaggggctttttctaggcttcagagcaggggagagctggaaggggctagaaagctcccgcttgtctgtttctcaggctcctgtgagcctcagtcctgagaccagagtcaagaggaagtacacgtccctaatcctgcttccctctctgggcctggctgccgggatctggggtccctaagtccctctctttaaagaacttctgcgggtcagactctgaagccgagttgctgtgggcgtgcccggaagcagagcgccacactcgctgcttaagctcccccagctctttccagaaaacattaaactcagaattgtgttttcagca

SEQ ID NO: 72878 - DNA, 2451 bp, Homo sapiens
cggggcacacacggttaatcctccgcggctgctgtttggacgaaaagcgctgggggtgttggaggctcctcgctgctcacatctggctgggcttcgctccttgcgcgtctgtcccactttctccctctcttcctttactttcgagaaaccgcgcttccgcttctggtcgcagagacctcggagaccgcgccggggagacggaggtgctgtgggtgggggggacctgtggctgctcgtaccgccccccaccctcctcttctgcactgccgtcctccggaagaccttttcccctgctctgtttccttcaccgagtctgtgcatcgccccggacctggccgggaggaggcttggccggcgggagatgctctaggggcggcgcgggaggagcggccggcgggacggagggcccggcaggaagatgggctcccgtggacagggactcttgctggcgtactgcctgctccttgcctttgcctctggcctggtcctgagtcgtgtgccccatgtccagggggaacagcaggagtgggaggggactgaggagctgccgtcgcctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcgggtggcggcagggcgtcccagggtgcggcaccgcggctccagtccttggaaataattaggcaaattctaaaggtctcaaaaggagcaaagtaaaccgtggaggacaaagaaaagggttgttatttttgtctttccagccagcctgctggctcccaagagagaggccttttcagttgagactctgcttaagagaagatccaaagttaaagctctggggtcaggggaggggccgggggcaggaaactacctctggcttaattcttttaagccacgtaggaactttcttgagggataggtggaccctgacatccctgtggccttgcccaagggctctgctggtctttctgagtcacagctgcgaggtgatgggggctggggccccaggcgtcagcctcccagagggacagctgagccccctgccttggctccaggttggtagaagcagccgaagggctcctgacagtggccagggacccctgggtcccccaggcctgcagatgtttctatgaggggcagagctcctggtacatccatgtgtggctctgctccacccctgtgccaccccagagccctggggggtggtctccatgcctgccaccctggcatcggctttctgtgccgcctcccacacaaatcagccccagaaggccccggggccttggcttctgttttttataaaacacctcaagcagcactgcagtctcccatctcctcgtgggctaagcatcaccgcttccacgtgtgttgtgttggttggcagcaaggctgatccagacccttctgcgggtcagactctgaagccgagttgctgtgggcgtgcccggaagcagagcgccacactcgctgcttaagctcccccagctctttccagaaaacattaaactcagaattgtgttttcagca

SEQ ID NO: 72879 - DNA, 3047 bp, Homo sapiens
  misc_feature (2063)..(2063): n is a, c, g, or t
  misc_feature (2174)..(2175): n is a, c, g, or t
  misc_feature (2189)..(2189): n is a, c, g, or t
  misc_feature (2274)..(2274): n is a, c, g, or t
  misc_feature (2322)..(2322): n is a, c, g, or t
  misc_feature (2334)..(2334): n is a, c, g, or t
  misc_feature (2339)..(2339): n is a, c, g, or t
  misc_feature (2432)..(2432): n is a, c, g, or t
  misc_feature (2435)..(2435): n is a, c, g, or t
  misc_feature (2455)..(2455): n is a, c, g, or t
  misc_feature (2475)..(2475): n is a, c, g, or t
  misc_feature (2477)..(2478): n is a, c, g, or t
  misc_feature (2500)..(2500): n is a, c, g, or t
  misc_feature (2611)..(2612): n is a, c, g, or t
  misc_feature (2697)..(2697): n is a, c, g, or t
  misc_feature (2702)..(2702): n is a, c, g, or t
  misc_feature (2714)..(2715): n is a, c, g, or t
  misc_feature (2833)..(2833): n is a, c, g, or t
  misc_feature (2835)..(2835): n is a, c, g, or t
  misc_feature (2854)..(2854): n is a, c, g, or t
  misc_feature (2915)..(2915): n is a, c, g, or t
  misc_feature (2937)..(2937): n is a, c, g, or t
  misc_feature (2939)..(2939): n is a, c, g, or t
  misc_feature (2968)..(2968): n is a, c, g, or t
cggggcacacacggttaatcctccgcggctgctgtttggacgaaaagcgctgggggtgttggaggctcctcgctgctcacatctggctgggcttcgctccttgcgcgtctgtcccactttctccctctcttcctttactttcgagaaaccgcgcttccgcttctggtcgcagagacctcggagaccgcgccggggagacggaggtgctgtgggtgggggggacctgtggctgctcgtaccgccccccaccctcctcttctgcactgccgtcctccggaagaccttttcccctgctctgtttccttcaccgagtctgtgcatcgccccggacctggccgggaggaggcttggccggcgggagatgctctaggggcggcgcgggaggagcggccggcgggacggagggcccggcaggaagatgggctcccgtggacagggactcttgctggcgtactgcctgctccttgcctttgcctctggcctggtcctgagtcgtgtgccccatgtccagggggaacagcaggagtgggaggggactgaggagctgccgtcgcctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcgggtggcggcagggcgtcccagggtgcggcaccgcggctccagtccttggaaataattaggcaaattctaaaggtctcaaaaggagcaaagtaaaccgtggaggacaaagaaaagggttgttatttttgtctttccagccagcctgctggctcccaagagagaggccttttcagttgagactctgcttaagagaagatccaaagttaaagctctggggtcaggggaggggccgggggcaggaaactacctctggcttaattcttttaagccacgtaggaactttcttgagggataggtggaccctgacatccctgtggccttgcccaagggctctgctggtctttctgagtcacagctgcgaggtgatgggggctggggccccaggcgtcagcctcccagggagtggcactaggtctggagcctcccatgcgcttgagtctaccacgagttggctatgcatatgcatgcccgatacgtggtcgtccctgatcaaggtgtgccacagggcacacccntgggggtccccccctagaggctcatgcacgcaatgcttgtcgtacttgaagcgtgggcacggaagctctctgcggtacactccagtgttagtcgagtcttccttgggtccnnacccgcgtgctgancctagcctccgaagatgacctctgtgaggtagggctcgcagtcatctcggagtacgcatgatcgaatgctccatgtgaaccaatnctgcagacatgttcactgatgctcgcgctcgcgtacacgcaacaatanaagaatccaagnactcncacagtgaaaagcgctccgcgccctggggcgtgcccttatagagggcttgtactgttcttccatgtcgtaactcatatataacacaggccctncanacgggcaagcacattctgtncaagttacttcgaccaaatncnntcactcaggtagggtgcttaangacaatcgagccaggctatcacagcgattgtagttctgatcgtatcgcgtatagagccatgccagacgagacgtggattgcctaggaaaccccccatttcattgtcgcgcnnccgacgtggccaccttccagttcacaagcgctcttcctagagcacaacgataaagtacattgcatagaagcgcgcgggctgtttntctcncttaaatgcggnncttgcaaggacgacaaggggcccgacgcaacgctagtgcaaatgcgcgagtctagggatagaagacctgcacccgtccgtttgagcatcgctcgtataccatcgtcacaagggggtcntntcgcgttgctcgacacggnctctgtacaagcctgcgcttgaaagtaacactcacgcatgggtcacaagacgaatgacaanagaggaagaccaaacttgctcncncgataagttcaatccgcggatggtctagngcgacattgtcatcctcctgccagaggcagcgctagatgcatgtgcgaatgaacgacgggcgaagtaggtcgcccatgg

SEQ ID NO: 72880 - DNA, 962 bp, Homo sapiens
cggggcacacacggttaatcctccgcggctgctgtttggacgaaaagcgctgggggtgttggaggctcctcgctgctcacatctggctgggcttcgctccttgcgcgtctgtcccactttctccctctcttcctttactttcgagaaaccgcgcttccgcttctggtcgcagagacctcggagaccgcgccggggagacggaggtgctgtgggtgggggggacctgtggctgctcgtaccgccccccaccctcctcttctgcactgccgtcctccggaagaccttttcccctgctctgtttccttcaccgagtctgtgcatcgccccggacctggccgggaggaggcttggccggcgggagatgctctaggggcggcgcgggaggagcggccggcgggacggagggcccggcaggaagatgggctcccgtggacagggactcttgctggcgtactgcctgctccttgcctttgcctctggcctggtcctgagtcgtgtgccccatgtccagggggaacagcaggagtgggaggggactgaggagctgccgtcgcctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactgaaggtgatgtaggtgtccagctcctcgctgaagatggcgttctcacgttcgcccttgtagaggcgtacccacaccttgtcctgctctcgcagctccagcatcaggctctg

SEQ ID NO: 72881 - DNA, 423 bp, Homo sapiens
ctaatccccagtttctgtgagtgtggccttatttggaaatagagtctctgcagatgtaatcaagttaagacaaggtcatcgtgaattaggtgtccaatgattgatgtccttatgagaagagagggagatttgaatacagacacagagacacaaacggagggaagaaggctggtgactgagtcctcgtcccccatctcctatgcctgcacagaggagaactctttgtaaacatcaagtgtcatgaccatcagcccctggaaaacatctggtctgccttcactagaggaccattttcaattactttggggataagaagattggccctgatggaaagtgaattgctcatgagatccagtcaatgaaagaaaaaaagaaaactgtactttagctcaggaactagaataaagtttccaaaaaacacac

SEQ ID NO: 72882 - DNA, 340 bp, Homo sapiens
tcaaggctgcagtgagctatgatcacaccactgtactccagcctgggtaacagaagaataccctgtctcttaaaaaggaaaatcaaataggggaaatgggatatataaataaagaacaatagtgaatgtgtcaggtgagatgacggacttgtaatgtgctgtggggggtcaaatatgaagaaggccttcttcctctggaaaggtcataaagaatgtcacacttgtgttggaacttgtgaagtgggtagaattttatcaagtagaaatgagagaaaggcatgccaagcaaaggatcggcatgaataaggtctactagtttgtggtcctctggctaagaatt

SEQ ID NO: 72883 - DNA, 492 bp, Homo sapiens
tgagctcagagggctccagtgtagagctttacccatggtcttgaacctgagagttctaagcacttgcttgcttttagttttctaaatcattcagagcatttttacccatggcctctaatatggtgtggatctgtgtcctcacccaaatctcgtgtcaaattgtaatccccaatgttggaggtggaggctggtgggaggtgattggatcatgggggcagtttctcatgaatgatttagcaccatctcccttggtcaagacagtgagtgagtgagttatcatgaaatctgtctgtttaaaagtatgtagtgcctccctccacccttcctcctcctctggccatgtaagatgtgctggcttccccttcgttttccaccatgactgtaagtttcttgaagcctccccagaagctgagcatgtgccagtatcatgcttcctgtacagcctgaagaactgtgtgccaattaaacctctttcctttataaattatctcg

SEQ ID NO: 72884 - DNA, 594 bp, Homo sapiens
caggaaatcatttcaaggttggacttgctggcaaaaacctagagtatagtaattttgtactgctgatttaaagatgcgccccatgctttgatatatataaatatggcaaagcttaggcttctagtataaaagctgggactcttggcatgttattacttagagagaagaccagtcgaattttgcatagaagtagacctgtgatacctataggtatggaaaatatgtcataagaagtggttttggattatttcaagtgtctgaataagtatttgattgaaaactctgaaagttctgtgccatggacaggtgtaatattaaaaatatttaatgattagtatggcatgggcacaaatcaagcagaacagatacctaattaatcagaacagcctttagcccttatgccacaccagagcttactagctaaatgtcatccttgaccatggaacatggttaaaatgagctgctggctgggcaaggtagctcatgtctgtaatcccagcactttgggaggtcgaggcaggaggatcgcttgagcccaggagtttgagaccagctaggtaacacagtgagatcccgtctctgttattaaaaaaa

SEQ ID NO: 72885 - DNA, 774 bp, Homo sapiens
gaaaaagatccccaaggatctgttactactgcatttccttcttgctctgtctacagcctaggccaactagtcagggtctggacatgcatctcctaaaggaagaactgtgtagcaccattgatcacaatgtaacatttccatgctgcattaagggtgtctctctctaatcatgattgtacctgtctcttcctgggtaaagggagatttttttttttaatgtgtaaagaattgatgcgagccaggaacatgtctgtagtcccagctacttgggcacacgcctgtagtccaggccactcgagcacacacctgtagtaccagctactctggaggctgaggcaggaggatcacttgagcccaggagattaagactgtagtatactatgatcgtgcctgtggctagccactgtgctccagcctgggcaacaccatcgtaaaaataaataaataaataaataaattggggaggacagcctcactggtatcagacttacaggaccagatagacaagatgggtataaggggagctgaagtctgtgttcatatgaggaagagaagaccaagccctgggactttggctgaattcctccgtggggctggacggcagtgatctcctgttccctatgtgtaaacaaagattccagggcgtggttttgcactcctgttgtactcttttagaggtggaaaagaggtggatactgagatctaagaggaaaggatagtcattcacgttctgagatatgcgctctctctattgtctcgtacacaaagggatag

SEQ ID NO: 72886 - DNA, 1493 bp, Homo sapiens
acctgaccagccaccccatagcccctggctgaagaagaaagagcatcttctctcccactgcaccccttctcctccaagaatagttgcccacattcccaaaatgtggaaagacttttcttttccttccggaacatgttcttcaccaccttttggagatttaaccatagctgccaaagctatgcacccagttggccttagaaaaccacaatgtttacagccctgtcttagggccgcggcttctcttatcttccaccaccttccttgcttgcagggttatcttctcacagggctggaatgcaaatttcagaggcttcttttgaagattccccaagtcaagcaggcaagatgcctagatcttctgttatctttgacatgtaacatcctttttagaggctcagaacacctccttggctgctatctcatgtgttagaatccagtttgtggtgaacctctttggaaggggaccccctctctttaaaccctgttcctctgtcctggtaacattctccttctaggagagcctctcttctgagaaggtaaaggaagggctgggtgagacacacagctatcctaggagccgtaggaagacaaaacttcccttttgttttactcctcactcctctatttttgttttactcacttctttatattttgttttactcctcactcctgtatattttggtttacttactcctctatttcagaaattgaaaaagatccccaaggatctgttactactgcatttccttcttgctctgtctacagcctaggccaactagtcagggtctggacatgcatctcctaaaggaagaactgtgtagcaccattgatcacaatgtaacatttccatgctgcattaagggtgtctctctctaatcatgattgtacctgtctcttcctgggtaaagggagatttttttttttaatgtgtaaagaattgatgcgagccaggaacatgtctgtagtcccagctacttgggcacacgcctgtagtccaggccactcgagcacacacctgtagtaccagctactctggaggctgaggcaggaggatcacttgagcccaggagattaagactgtagtatactatgatcgtgcctgtggctagccactgtgctccagcctgggcaacaccatcgtaaaaataaataaataaataaataaattggggaggacagcctcactggtatcagacttacaggaccagatagacaagatgggtataaggggagctgaagtctgtgttcatatgaggaagagaagaccaagccctgggactttggctgaattcctccgtggggctggacggcagtgatctcctgttccctatgtgtaaacaaagattccagggcgtggttttgcactcctgttgtactcttttagaggtggaacgctctctctattgtctcgtacacaaagggatagtctcttttctggagctgatgtccctgcttggaggttagccccaaaacatggctcttgtattgttcta

SEQ ID NO: 72887 - DNA, 736 bp, Homo sapiens
ttgaagattttttctcataatttatgtattgaagagatgtgagatattatcaattcaaatttcctcttgcactagaggctgggtgacattaagctcaccagctagttagtaaccaagccaggccttgaaactggtctgttcattttaaataataattagcattaattgaaattctcatgtgcagtctggttttctaattttcccaacaaccctaggaggcagttactgtcgttactgcattttgcagacaaggaaactgaggcgtagggacttgtctcaggtcatatagccagtaagaggtgaagctagtgcagtatgtttagtcctcatcctacactaccaattattttccaggcactcaaatttgtaaatgcccggagtatttgggctgttctaataagctgcagttttcagaggcattgtgtaagaatctgaagatttcttatttatctcctattgttgctctatgtaaatataatacaggacatcatcctaaaaagtatctttctttaaaggtgaacaaagggaagataaatacgaaaatgaggaagaaagaaaatcaggagaggataaaatcacaaaaggttagggaaggagaaacttttaaggagaatggagtgtttcatagtgtcaagtaccacagaaaggtcaagtaagatcagagctgaaaatttaccgttggatttggcaattaggaggtgactggtgaccttgacaactgcaatttcagtgtagc

SEQ ID NO: 72888 - DNA, 1623 bp, Homo sapiens
agagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtggctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaa

SEQ ID NO: 72889 - DNA, 1980 bp, Homo sapiens
tttgttgatactgaggagatgactgggacccacttacataggactatcaaaacttatctgcagcaaattggagttgatatggataaaatacatggccaggcctatgatagcaccactaatttgaagataaaatttaataaaatagcagcagaattcaagaaagaagaaccaagagctttatacatacattgttatgcacactttttggatttatcaataattaggttttgtaaagaagtaaaagaactccgaagtgctctaaaaactctcagttctttgttcaacactatttgtatgtctggggaaatgttggcaaattttcgaaacatttataggctaagtcaaaacaaaacatgcaagaaacatatatcacaatcatgttggacagtccatgatcgtacattactatctgtgattgacagtcttccagagattattgaaacattggaagttatagcaagccattcttcaaatacaagtttcgccgatgaattgagtcatttgctgacattggtttccaaatttgaatttgtcttttgtttgaaattcctgtatcgagtgctgagtgttacaggaattctttccaaagagcttcaaaataaaaccatagacattttttctttgtcttcaaaaatagaagcaattttggaatgtttatcatctgaaagaaatgacgtatactttaaaacaatctgggatggaacagaggaaatatgtcaaaaaataacctgtaaaggttttaaagttgaaaaaccttctcttcagaaaagaagaaaaattcagaaatcagtagatcttggcaattcagataatatgttttttcctacttcaacagaagaacaatataaaattaatatctattaccaaggattagatactatattacaaaatttaaagttatgtttttcggagtttgattattgcaaaataaagcaaatttcagaactgttatttaaatggaatgaaccattaaatgaaacaacagcaaaacatgttcaggaattttataaacttgatgaggacattatcccagaacttagattttatcgacattatgcaaagcttaactttgtcatagatgatagttgcataaacttcgtcagtctcggctgtttgtttattcagcatggtcttcacagtaatattccttgtctctcaaagctattatatattgctttgtcttggccaattacttcagcaagtactgagaactcattttctaccctgcctcgtcttaagacatatttatgtaataccatgggacaagagaagcttactggcccagccctaatggctgttgagcaggagttggtaaataaactaatggagcctgaaagactcaatgaaattgtggaaaagtttatcagtcagatgaaagaaatataatacatgctcatttgaacttacctaaaagacttgtatttccattgggatgttttcatttcaaaattgttcaaaattcaaaagacacagaacgataaacagtgaagtctccttccctcctttagaactcattttctcttcccaaaaagtgttatcttttccttaaatatccctctagaggtatttttcctaagtggtattgtacggtgtatactgttcttcagcttgtcttctctgtgtaacatatttttgagattgtcccatgtcgttacatgaagagtttcttgattcttggtctataattgcagatgttattgtatgaatgtaccataatatatttgagcagtccctgctgacatttttttcctaaccttttgctattataaataatgattcattttataaccttttatataggtcacattgcacatgagtgagttactgtaagctggaaatctaaagttagaattactaggttaagatatgtgcatttttacttttgatagatattggcaagttgccatctataaggattgtgccagtttacagtcccacccacaatgcatgagagtgcctattaaatctttgtaagtgtta

SEQ ID NO: 72890 - DNA, 2544 bp, Homo sapiens
tttgttgatactgaggagatgactgggacccacttacataggactatcaaaacttatctgcagcaaattggagttgatatggataaaatacatggccaggcctatgatagcaccactaatttgaagataaaatttaataaaatagcagcagaattcaagaaagaagaaccaagagctttatacatacattgttatgcacactttttggatttatcaataattaggttttgtaaagaagtaaaagaactccgaagtgctctaaaaactctcagttctttgttcaacactatttgtatgtctggggaaatgttggcaaattttcgaaacatttataggctaagtcaaaacaaaacatgcaagaaacatatatcacaatcatgttggacagtccatgatcgtacattactatctgtgattgacagtcttccagagattattgaaacattggaagttatagcaagccattcttcaaatacaagtttcgccgatgaattgagtcatttgctgacattggtttccaaatttgaatttgtcttttgtttgaaattcctgtatcgagtgctgagtgttacaggaattctttccaaagagcttcaaaataaaaccatagacattttttctttgtcttcaaaaatagaagcaattttggaatgtttatcatctgaaagaaatgacgtatactttaaaacaatctgggatggaacagaggaaatatgtcaaaaaataacctgtaaaggttttaaagttgaaaaaccttctcttcagaaaagaagaaaaattcagaaatcagtagatcttggcaattcagataatatgttttttcctacttcaacagaagaacaatataaaattaatatctattaccaaggattagatactatattacaaaatttaaagttatgtttttcggagtttgattattgcaaaataaagcaaatttcagaactgttatttaaatggaatgaaccattaaatgaaacaacagcaaaacatgttcaggaattttataaacttgatgaggacattatcccagaacttagattttatcgacattatgcaaagcttaactttgtcatagatgatagttgcataaacttcgtcagtctcggctgtttgtttattcagcatggtcttcacagtaatattccttgtctctcaaagctattatatattgctttgtcttggccaattacttcagcaagtactgagaactcattttctaccctgcctcgtcttaagacatatttatgtaataccatgggacaagagaagcttactggcccagccctaatggctgttgagcaggagttggtaaataaactaatggagcctgaaagactcaatgaaattgtggaaaagtttatcagtcagatgaaagaaatataatacatgctcatttgaacttacctaaaagacttgtatttccattgggatgttttcatttcaaaattgttcaaaattcaaaagacacagaacgataaacagtgaagtctccttccctcctttagaactcattttctcttcccaaaaagtgttatcttttccttaaatatccctctagaggtatttttcctaagtggtattgtacggtgtatactgttcttcagcttgtcttctctgtgtaacatatttttgagattgtcccatgtcgttacatgaagagtttcttgattcttggtctataattgcagatgttattgtatgaatgtaccataatatatttgagcagtccctgctgacatttttttcctaaccttttgctattataaataatgattcattttataaccttttatataggtcacattgcacatgagtgagttactgtaagctggaaatctaaagttagaattactaggttaagatatgtgcatttttacttttgatagatattggcaagttgccatctataaggattgtgccagtttacagtcccacccacaatgcatgagagtgcctattaaatctttgtaagtgttatcaaatgttttgatctttcctaatctcttactttaaaaatggcgttttaatctcagtagaattttgtatattcacttaagaataaggttggggactgggcgtggtggttcacacctataatctcagccctttgagggcctacacaggaaggaagatcgcttgaggccacgagttcaagatgaggttggcaacatggtaagacctcatcactacaatttttttttttttaaattagtgaagtgtggtactgcacacccgaagtcccagctacttgggaggctgaggcaggaggattgcttaagcccagaaatttgaggctgcagtgagccatgattgcaccactatgctccagagtctaggcaacagagtgagaccttatctctttaaaacaaacaagaatgaagttaggtatctgtttatttgtttgagccatttgtatttccttttttgtagactgtcctgtttaaacgttaaaatcactgctgtggttttgatttatacatctcagctggatggcacaataaattattaagccatgttatgaaaatataactatatttaagt

SEQ ID NO: 72891 - DNA, 505 bp, Homo sapiens
gaaacagctggagaaaagtgccagagaaatagtctttaaaaaaaaaaaaaaaggccgggcgcggtggctcacgcctgtaatcccagcactttgggaggccgaggcgggcggatcacgaggtcaggagatcgagaccacggtgaaaccccgtctctactaaaaatacaaaaaatcagccgggcacagtggcgggcgcctgtagtcccagctacttgggaggctgaggcaggaggattgcttaagcccagaaatttgaggctgcagtgagccatgattgcaccactatgctccagagtctaggcaacagagtgagaccttatctctttaaaacaaacaagaatgaagttaggtatctgtttatttgtttgagccatttgtatttccttttttgtagactgtcctgtttaaacgttaaaatcactgctgtggttttgatttatacatctcagctggatggcacaataaattattaagccatgttatgaaaatataactatatttaagt

SEQ ID NO: 72892 - DNA, 372 bp, Homo sapiens
ccttgcaaaactgtggtacagaatcacagccaggatatcaacattgatgcaatccgtggatcttagttcagatttccccagttctgcttgttctcgtgtgtgtgtatgtagttctgtacagttgtgccacatgtgtaggtttatgtatccaccatcacattcaagatattttctgtgacagatacttttatatactccttgttctttttatttatttatttttttattttttgagatagagccttgctctgtcgggcgatcttggctcactgcaacctctgcctcccgggttgaagcgattcccctgcctcagcctcctgtgtagcggggaccatagcacccaccaccacgccgagccctatgcagtcttcg

SEQ ID NO: 72893 - DNA, 449 bp, Homo sapiens
aacgttattaatttatgtatttttaaaatataaaacattgtcaattgtagggaacaggcttcactgggatcttttagggaatatcttcagcttgatgaaataattcccgaatagccaagtggtctgacaagatcgagagtaatgaggcccatactttagtacagtcttgaatggccagatggtgctgggcataccccaaccagagatatgtaagtctttatgttgtcaaaatttcccagaaacatgaatttcccactaagattcattaaggaaaactagaatgaaaacaaaaacgttccttgtataatattcattagaaagaaatgaagaaggccgggcatggtggctcacgcctgtaatcccagcactttgagaggccaaggtaggcagatcatgaggtcaggagtttgagaccagcctggccaacatagtgaaatcccgtctctacc

SEQ ID NO: 72894 - DNA, 393 bp, Homo sapiens
taaagaaatttcaagataatacaagccatactgccagagagtaaaaagtgagcaaaaaaagtagatactcagaaatggaagattaaatactacatgttctcacttataagtgggaaccaaatgtgtacatatggacctacagagtgaaataatagacactggggactcggaaaggtgagaaagtgggatggggatgagggatgagaaattacctaataagtacaatgttcactgctcaggtgatggttacactaaagcacagacgtcaccaccacgcagtatatccatataacaaaactgcattgtacccctgtaaatctataaaaattaaaattaaaaataggccaggtgcggtgtctcacacctgtagtcccagcacttcgggagcccaag

SEQ ID NO: 72895 - DNA, 273 bp, Homo sapiens
aaaataataatggtaataataaaaacaaataagacttcacagtgatgctttgaaaaaaatagtcaatatttatgaagcgtatcccacatctagacacctcctggtggaattattgaacctcaagggtaatagggaatctttctgtcctctagggggagagggaaacggagctacttgcccagaaaaattctcaggctggccttggatctttccctcaaggcactcatatgcgggctattcattgagaaaatgcagtggggtggaggcagacat

SEQ ID NO: 72896 - DNA, 181 bp, Homo sapiens
aaaaatagagatgatgaagatatcaagaaattcataaaatgggaggtgaattcagctgctgagcactggggagagagattgaaattgggaagggggaaattttaaagtagaggtttatatcagtcatcatgggacatgctattagaattcaagacacaacaaggaaatcttaggggtccag

SEQ ID NO: 72897 - DNA, 531 bp, Homo sapiens
taaagcagcactatgcctggcatgtaagaaagtgccaactgtcgacagatgatccaaaagatttccttctaagcatctaacactgactgaggtcactgaagaccacactggcaggaatttcagggactgatgacatctccttcccttgtactcatgtttgagagagtaggtctgattcccttactgcaggcccccatgaggtctgatacggttcggctctgtgtccccacgcaaatctcatctctaattgttatccccatgtgtcaagggagggacctggtgggaagtgcttgcatcatggggacggttttcccctatgctgttctcctgatactgaattctcccgagagctgatggttttaaaagtgtaacagttcccccttcacttgcgtgcttgcttgttctctcttgccaccttgtgaagaaggtacctacttcccctttgccttccgccataattgtaagtttcttgaggcctccccagccacacagaactgagtcaattaaacctcttttgtttgtaaaaaagca

SEQ ID NO: 72898 - DNA, 2143 bp, Homo sapiens
agcgggaaggcaggtggcggggcgtctccgagcggcggggccaagggagggcacaacagctgctacctgaacagtttctgacccaacagttacccagcgccggactcgctgcgccccggcggctctagggacccccggcgccaacacttagctccgcgcccgagagaatgttggaccgacgacacaagacctcagacttgtgttattctagcagctgaacacaccccaggctcttctgaccggcagtggctctggaagcagtctggtgtatagagttatggattcactaccagattctactgtatgctcttgacaactatgaccacaatggtccacccacaaatgaattatcaggagtgaacccagaggcacgtatgaatgaaagtcctgatccgactgacctggcgggagtcatcattgagctcggccccaatgacagtccacagacaagtgaatttaaaggagcaaccgaggaggcacctgcgaaagaaagtgtgttagcacgactttccaagtttgaagttgaagatgctgaaaatgttgcttcatatgacagcaagattaagaaaattgtgcattcaattgtatcatcctttgcatttggactatttggagttttcctggtcttactggatgtcactctcatccttgccgacctaattttcactgacagcaaactttatattcctttggagtatcgttctatttctctagctattgccttattttttctcatggatgttcttcttcgagtatttgtagaaaggagacagcagtatttttctgacttatttaacattttagatactgccattattgtgattcttctgctggttgatgtcgtttacattttttttgacattaagttgcttaggaatattcccagatggacacatttacttcgacttctacgacttattattctgttaagaatttttcatctgtttcatcaaaaaagacaacttgaaaagctgataagaaggcgggtttcagaaaacaaaaggcgatacacaagggatggatttgacctagacctcacttacgttacagaacgtattattgctatgtcatttccatcttctggaaggcagtctttctatagaaatccaatcaaggaagttgtgcggtttctagataagaaacaccgaaaccactatcgagtctacaatctatgcagtgaaagagcttacgatcctaagcacttccataatagggtcgttagaatcatgattgatgatcataatgtccccactctacatcagatggtggttttcaccaaggaagtaaatgagtggatggctcaagatcttgaaaacatcgtagcgattcactgtaaaggaggcacagatagaacaggaactatggtttgtgccttccttattgcctctgaaatatgttcaactgcaaaggaaagcctgtattattttggagaaaggcgaacagataaaacccacagcgaaaaatttcagggagtagaaactccttctcagaagagatatgttgcatattttgcacaagtgaaacatctctacaactggaatctccctccaagacggatactctttataaaacacttcattatttattcgattcctcgttatgtacgtgatctaaaaatccaaatagaaatggagaaaaaggttgtcttttccactatttcattaggaaaatgttcggtacttgataacattacaacagacaaaatattaattgatgtattcgacggtccacctctgtatgatgatgtgaaagtgcagtttttctcttcgaatcttcctacatactatgacaattgctcattttacttctggttgcacacatcttttattgaaaataacaggctttatctaccaaaaaatgaattggataatctacataaacaaaaagcacggagaatttatccatcagattttgccgtggagatactttttggcgagaaaatgacttccagtgatgttgtagctggatccgattaagtatagctcccccttccccttctgggaaagaattatgttctttccaaccctgccacatgttcatatatcctaaatctatcctaaatgttccttgaagtatttatttatgtttatatatgtttatatatgttcttcataaatctattacatatatatagataaaatgt

SEQ ID NO: 72899 - DNA, 2197 bp, Homo sapiens
agcgggaaggcaggtggcggggcgtctccgagcggcggggccaagggagggcacaacagctgctacctgaacagtttctgacccaacagttacccagcgccggactcgctgcgccccggcggctctagggacccccggcgccaacacttagctccgcgcccgagagaatgttggaccgacgacacaagacctcagacttgtgttattctagcagctgaacacaccccaggctcttctgaccggcagtggctctggaagcagtctggtgtatagagttatggattcactaccagattctactgtatgctcttgacaactatgaccacaatggtccacccacaaatgaattatcaggagtgaacccagaggcacgtatgaatgaaagtcctgatccgactgacctggcgggagtcatcattgagctcggccccaatgacagtccacagacaagtgaatttaaaggagcaaccgaggaggcacctgcgaaagaaagcccacacacaagtgaatttaaaggagcagcccgggtgtcacctatcagtgaaagtgtgttagcacgactttccaagtttgaagttgaagatgctgaaaatgttgcttcatatgacagcaagattaagaaaattgtgcattcaattgtatcatcctttgcatttggactatttggagttttcctggtcttactggatgtcactctcatccttgccgacctaattttcactgacagcaaactttatattcctttggagtatcgttctatttctctagctattgccttattttttctcatggatgttcttcttcgagtatttgtagaaaggagacagcagtatttttctgacttatttaacattttagatactgccattattgtgattcttctgctggttgatgtcgtttacattttttttgacattaagttgcttaggaatattcccagatggacacatttacttcgacttctacgacttattattctgttaagaatttttcatctgtttcatcaaaaaagacaacttgaaaagctgataagaaggcgggtttcagaaaacaaaaggcgatacacaagggatggatttgacctagacctcacttacgttacagaacgtattattgctatgtcatttccatcttctggaaggcagtctttctatagaaatccaatcaaggaagttgtgcggtttctagataagaaacaccgaaaccactatcgagtctacaatctatgcagtgaaagagcttacgatcctaagcacttccataatagggtcgttagaatcatgattgatgatcataatgtccccactctacatcagatggtggttttcaccaaggaagtaaatgagtggatggctcaagatcttgaaaacatcgtagcgattcactgtaaaggaggcacagatagaacaggaactatggtttgtgccttccttattgcctctgaaatatgttcaactgcaaaggaaagcctgtattattttggagaaaggcgaacagataaaacccacagcgaaaaatttcagggagtagaaactccttctcagaagagatatgttgcatattttgcacaagtgaaacatctctacaactggaatctccctccaagacggatactctttataaaacacttcattatttattcgattcctcgttatgtacgtgatctaaaaatccaaatagaaatggagaaaaaggttgtcttttccactatttcattaggaaaatgttcggtacttgataacattacaacagacaaaatattaattgatgtattcgacggtccacctctgtatgatgatgtgaaagtgcagtttttctcttcgaatcttcctacatactatgacaattgctcattttacttctggttgcacacatcttttattgaaaataacaggctttatctaccaaaaaatgaattggataatctacataaacaaaaagcacggagaatttatccatcagattttgccgtggagatactttttggcgagaaaatgacttccagtgatgttgtagctggatccgattaagtatagctcccccttccccttctgggaaagaattatgttctttccaaccctgccacatgttcatatatcctaaatctatcctaaatgttccttgaagtatttatttatgtttatatatgtttatatatgttcttcataaatctattacatatatatagataaaatgt

SEQ ID NO: 72900 - DNA, 1857 bp, Homo sapiens
  misc_feature (1825)..(1825): n is a, c, g, or t
agcgggaaggcaggtggcggggcgtctccgagcggcggggccaagggagggcacaacagctgctacctgaacagtttctgacccaacagttacccagcgccggactcgctgcgccccggcggctctagggacccccggcgccaacacttagctccgcgcccgagagaatgttggaccgacgacacaagacctcagacttgtgttattctagcagctgaacacaccccaggctcttctgaccggcagtggctctggaagcagtctggtgtatagagttatggattcactaccagattctactgtatgctcttgacaactatgaccacaatggtccacccacaaatgaattatcaggagtgaacccagaggcacgtatgaatgaaagtcctgatccgactgacctggcgggagtcatcattgagctcggccccaatgacagtccacagacaagtgaatttaaaggagcaaccgaggaggcacctgcgaaagaaagcccacacacaagtgaatttaaaggagcagcccgggtgtcacctatcagtgaaagtgtgttagcacgactttccaagtttgaagttgaagatgctgaaaatgttgcttcatatgacagcaagattaagaaaattgtgcattcaattgtatcatcctttgcatttggactatttggagttttcctggtcttactggatgtcactctcatccttgccgacctaattttcactgacagcaaactttatattcctttggagtatcgttctatttctctagctattgccttattttttctcatggatgttcttcttcgagtatttgtagaaaggagacagcagtatttttctgacttatttaacattttagatactgccattattgtgattcttctgctggttgatgtcgtttacattttttttgacattaagttgcttaggaatattcccagatggacacatttacttcgacttctacgacttattattctgttaagaatttttcatctgtttcatcaaaaaagacaacttgaaaagctgataagaaggcgggtttcagaaaacaaaaggcgatacacaagggatggatttgacctagacctcacttacgttacagaacgtattattgctatgtcatttccatcttctggaaggcagtctttctatagaaatccaatcaaggaagttgtgcggtttctagataagaaacaccgaaaccactatcgagtctacaatctatgcagtgaaagagcttacgatcctaagcacttccataatagggtcgttagaatcatgattgatgatcataatgtccccactctacatcagatggtggttttcaccaaggaagtaaatgagtggatggctcaagatcttgaaaacatcgtagcgattcactgtaaaggaggcacagatagaacaggaactatggtttgtgccttccttattgcctctgaaatatgttcaactgcaaaggaaagcctgtattattttggagaaaggcgaacagataaaacccacagcgaaaaatttcagggagtagaaactccttctcagaagagatatgttgcatattttgcacaagtgaaacatctctacaactggaatctccctccaagacggatactctttataaaacacttcattatttattcgattcctcgttatgtacgtgatctaaaaatccaaatagaaatggagaaaaaggttgtcttttccactatttcattaggaaaatgttcggtacttgataacattacaacagacaaaatattaattgatgtattcgacggtccacctctgtatgatgatgtgaaagtgcagtttttctcttcgantcttcctacataacgtaacgggagatcctcta

SEQ ID NO: 72901 - DNA, 543 bp, Homo sapiens
cgttgtgctgttttctgtttataaagttggcggtgatggcaatcgcaagcttcccaggggattttttttttttgaacccttccagggtgttcttgcggcaatgggcaaccaaatgatgacgtcaaactccaactcccgcaaaaaaatggtttgtaggaaaaaattctgcccgggttgtgggggaaggggagcctggagaaaacaaagtcactattcccttttttgaaacaggaaaaaaaattattttttgttcagtaaaaatggtagagaattccaatgtccctagccacaagggaccagttccactgagaagtgaacagtgggaactcaaaatttcagaaacattgggggaagggaaaattggctttctcttaattggcagatgttccagtggggggggggggctctgtttttgttgggatgtgttatgttgtatgtacgcatatatggaccggagtctgctgagtttataaggttccaaaaatatggtaaaatcttggtttttgttaatttatctcaataaaagcccactggaactccaaa

SEQ ID NO: 72902 - DNA, 798 bp, Homo sapiens
agcgggaggcggcgggcgggcgaacgggcgagcgagggagggggcagaggagccgagttagctcagccaggcggcgacttcggcggcgccacgagagcgggcagcggaggagattgacgtgagtgaattcagatataactcaagcttgttagagggctttttaaaaataaaaagttgattccgtgcaagagagcaagttactgctgcttaccgttcagagacttacaggtgcttgcctgcattgcaataaaggactcatttattgagcaagacttatatttatctcttcattttggagagcctaataaactgttattacagtttctctactgactttcaaaagttttgaagtttgaaagacctttgcaattaaaacagcatgagcacggccagaacagagaaccctgttataatgggtctgtccagtcaaaatggtcagctgagaggccctgtgaaacccactggtggccctggaggagggggcacacagacacagcaacagatgaaccagctgaaaaacaccaacacaatcaataatggcactcagcagcaagcacagagtatgaccaccactattaagtaagtgttagagtaaattattaataaacacttgtggggaaccaagatttgtgttactttggtgttgactattaatacttatgccttaatttaaccattttgattccaaatagaggacagatgactttgttttatggccagtaggtatttgcaatagaataatatatttctgccataatttgttcagcaagtagtcatcctgaggtcagatgatacaca

SEQ ID NO: 72903 - DNA, 797 bp, Homo sapiens
agcgggaggcggcgggcgggcgaacgggcgagcgagggagggggcagaggagccgagttagctcagccaggcggcgacttcggcggcgccacgagagcgggcagcggaggagattgacgtgagtgaattcagatataactcaagcttgttagagggctttttaaaaataaaaagttgattccgtgcaagagagcaagttactgctgcttaccgttcagagacttacaggtgcttgcctgcattgcaataaaggactcatttattgagcaagacttatatttatctcttcattttggagagcctaataaactgttattacagtttctctactgactttcaaaagttttgaagtttgaaagacctttgcaattaaaacagcatgagcacggccagaacagagaaccctgttataatgggtctgtccagtcaaaatggtcagctgagaggccctgtgaaacccactggtggccctggaggagggggcacacagacacagcaacagatgaaccagctgaaaaacaccaacacaatcaataatggcactcagcagcaagcacagagtatgaccaccactattaagaggagagcattcccattgctttatctggtagggatatcttagctagagcaaaaaatggaacaggcaagagcggtgcctacctcattcccttacttgaacggctagacctgaagaaggacaatatacaaggttagttgaataaaagtttgtttttaaactaaaaatgggagtttcagccttggagccatgtgtagaagatactctttttttagtcaga

SEQ ID NO: 72904 - DNA, 575 bp, Homo sapiens
  misc_feature (85)..(85): n is a, c, g, or t
  misc_feature (94)..(94): n is a, c, g, or t
tttaaggctagggatgctgtatagtcccattagaaagctttttttcttaactgcacttagatttgttgtcctttttattactgcnccgcccccnccaaaaaatttctggtctgtctttagcttcatttctgaacattttatcttggcctcccagagtgctgggattacaggcgtgagccactgcatcataaggtgcagttacaggtgtgagccactgcatcataaggcgcagtatttctatagcttcttaaattttgtaaataatgatgtatagcatgttctcccacctcaccccatattttcttatatattccttgatactgtttcagcaatggtgattgttcccactagagaacttgctctacaggtcagtcaaatttgcatccaggtcagcaaacacatgggaggggccaaagtgatggcaaccacaggaggaaccaatttacgagatgacataatgaggcttgatgatacaggtaagaaatgattactaaaaggtagtgtagctctctgttattttagtcacaagtatttcagtaaattattaaaaattgtttttaagattaaggatagag

SEQ ID NO: 72905 - DNA, 483 bp, Homo sapiens
tcatggtcgagtctggatctagagcagcccccgacatctacaactatctgggagagggaatttaaaaggtgtcaacttttgaccaaaaaaattgtgcccttgtaccgatgcagctctctttctcccccacctcttgcgagataagagggatcattcatgtagaagaaaagagtataaatgcaattctgtatctcgctagagaacgtgtgggtgactaaacaaaaagtgcagtctccttcaccaactttagactgcgtggtgccacatgcctgtgggtccctcttaaagcacagacttaaaatggaaagtattactgaagtatagcctctaatgaggagtggcacttaaactatctgggacaccactactggacacggtcttgtagaggcagctgtccagttttggtgcttgactcttgaataggaattgttaaatggaaagatgctctgagtgactaggtcaaagcctggtcttttttttttt

SEQ ID NO: 72906 - DNA, 4481 bp, Homo sapiens
agcgggaggcggcgggcgggcgaacgggcgagcgagggagggggcagaggagccgagttagctcagccaggcggcgacttcggcggcgccacgagagcgggcagcggaggagattgacgtgagtgaattcagatataactcaagcttgttagagggctttttaaaaataaaaagttgattccgtgcaagagagcaagttactgctgcttaccgttcagagacttacaggtgcttgcctgcattgcaataaaggactcatttattgagcaagacttatatttatctcttcattttggagagcctaataaactgttattacagtttctctactgactttcaaaagttttgaagtttgaaagacctttgcaattaaaacagcatgagcacggccagaacagagaaccctgttataatgggtctgtccagtcaaaatggtcagctgagaggccctgtgaaacccactggtggccctggaggagggggcacacagacacagcaacagatgaaccagctgaaaaacaccaacacaatcaataatggcactcagcagcaagcacagagtatgaccaccactattaaacctggtgatgactggaaaaagactttaaaactccctccaaaggatctaagaatcaaaacttcggatgtgacctccacaaaaggaaatgagtttgaagattactgtttgaaacgggagttactgatgggaatttttgaaatgggctgggaaaagccatctcctattcaggaggagagcattcccattgctttatctggtagggatatcttagctagagcaaaaaatggaacaggcaagagcggtgcctacctcattcccttacttgaacggctagacctgaagaaggacaatatacaagcaatggtgattgttcccactagagaacttgctctacaggtcagtcaaatttgcatccaggtcagcaaacacatgggaggggccaaagtgatggcaaccacaggaggaaccaatttacgagatgacataatgaggcttgatgatacagtgcacgtggtgattgctacccctgggagaatcctggatcttattaagaaaggagtagcaaaggttgatcatgtccagatgatagtattggatgaggcagataagttgctgtcacaggattttgtgcagataatggaggatattattctcacgctacctaaaaacaggcagattttactatattccgctactttccctcttagtgtacagaagttcatgaattcccatttgcagaaaccctatgagattaacctgatggaggaactaactctgaagggagtaacccagtactacgcatatgtaactgagcgccaaaaagtacactgcctcaacacacttttctccaggcttcagataaaccagtcgatcattttctgtaactcctctcagcgagttgaattgctagccaagaagatttctcaactgggttattcttgcttctatattcatgctaaaatgaggcaggaacatcgaaatcgtgtatttcatgatttccgaaatggcttatgccgcaatcttgtttgcactgatctgtttacccgaggtattgatatacaagctgtgaatgtggtaataaactttgatttcccaaagctggcagagacctatctccatcgtattggaagatcaggtcgctttggtcatcttggcttagccatcaacttgatcacatatgatgatcgcttcaacctgaaaagtattgaggagcagctgggaacagaaattaaacctattccgagcaacattgataagagcctgtatgtggcagaataccacagcgagcctgtagaagatgagaaaccttaacaagcatgctttgacaaattacaaaaggctcgtttggatctgtgacacatcgttttggggggaatgctcttctctttgtgggtttttcatcttttattttggaactatgaagacttaaaagagctcagacattttctttttttaactggtgaagagaaaaaggctgaaaagaaggaatataccttttttgttccacttgtttgcactgtgtgctgactgaacattagttgcactaactgctggtttttaaaaaatgttttctggggaaaggggacaaggaaggaaaagaaagaagagaaggggagaaaccctaaaaagagaagaatcttaatgaacacacaagcttgtcaatgatttcaaaattctccaacagctgactctcgtgcatttcaacttctccctgattcctcatccgttttttaagcctgaagagcttattacttatttgtgcgaagtgccttatgctatgagaccattcagaatatcatcttttagacacagcccgaggaatcaacaatagtaactctttctttccgtttttttttctttttcttttaaaaaatgtctttttattttggtttcaggttgaagtctcttccctttctacccagtactcgagcccagggctagaagttgaaactcactagtaatgttaaacaccattttttttttctttttggggaggagttgatatgcaactgcagttcatccgcactgtaaatacatgtatttaaaaaaacaatcccaagtaaaaatttcttctgggctgagtagataaaaaacatcatcgctcccaaaggaaagagcagtctatcattgcaggagccatatgacaagcctttgtgctctatagcagacactaaagactgggttacatatgcctccagtagtagtatggcacttgatgtgtagacatgtcagagccttggccctctttcctctgtggcaaagcgtgtcccatagaaaattgggtgtgtatacttgtataaactttgtaaataagttttttttctgggttcatatatatatatatatatacatatatatatattttttttttggatgaaggttgctgggattaaggggattagagtgattatgggagcagctaaagatgagaggggctcagttttacgcaacactaaattctagaaagtactttggcctcgtgctgtagagagcagatttctatggtaccctgtgttagtaaaggggcccagaaatctgggatgtactgtttgctgccacactgtctcatctagtacctttggagtaggtttaccagagagagcaaggaagcttcaaaacattgataattcaagatttattttgagaagctctgattttgcttcttccccctttctaaaagtttgaggaatatttcaagctctgcaacagggggcaaagattaatctaccttgcagtgtaggaattctattgagtggcagtgtcattgagcagtatatatataaagcacagatttgcatttcagaatattagccagtaccagctttggtaatgttagcagttctggagcttaattttctgtggatcatttcctgtagtgtgtaaatgtgttgccctctgcccgctttgatacataaacttttgcaggaatgggcaacctgagagctgttaactttcatgctacagaaagctgcttgccattctcttgcattgtgacaagaattgttacctgtcattttgcactgtaaattgctggcagatgctttacagtcaatagtgttgctttaaattgtgcccctcccaacatgcttgatgtttggcctgatctccaggcaaaaggagtgagatgaatcaaaaccagtgaacttttttttttaatgtttttaattcccttttaacccagtgtactaggtcaatcaggaggcatctggaaagggggggaaaaaagcaaaaaacaaaattaaaaaaaattgatttccatattttttcaaaaccctaaaatattacaaaataagtcccgcatatactttaatgttttaactcttttggacaaaggaatcaattacttgaagttgcttttttgactctgcctacttctgagcaaactatttgcgactcacccacaattccttggagatcaaaatcctacagatgcctcctgatgggacatagccctaactccttaacaactgtagcaagaactgcacggtacaaacccaaaaaagaacaagctcatctatttggaacccaagcctcatattttctgtccagtcaatgttggttactaaatagaaaacctaattaaggaagtaacttttttccagggaggggtgggagagggaatttaaaaggtgtcaacttttgaccaaaaaaattgtgcccttgtaccgatgcagctctctttctcccccacctcttgcgagataagagggatcattcatgtagaagaaaagagtataaatgcaattctgtatctcgctagagaacgtgtgggtgactaaacaaaaagtgcagtctccttcaccaactttagactgcgtggtgccacatgcctgtgggtccctcttaaagcacagacttaaaatggaaagtattactgaagtatagcctctaatgaggagtggcacattatatctactccgtgtgacaaccatttcccgagctcatcctgttgccgcggtca

SEQ ID NO: 72907 - DNA, 4564 bp, Homo sapiens
agcgggaggcggcgggcgggcgaacgggcgagcgagggagggggcagaggagccgagttagctcagccaggcggcgacttcggcggcgccacgagagcgggcagcggaggagattgacgtgagtgaattcagatataactcaagcttgttagagggctttttaaaaataaaaagttgattccgtgcaagagagcaagttactgctgcttaccgttcagagacttacaggtgcttgcctgcattgcaataaaggactcatttattgagcaagacttatatttatctcttcattttggagagcctaataaactgttattacagtttctctactgactttcaaaagttttgaagtttgaaagacctttgcaattaaaacagcatgagcacggccagaacagagaaccctgttataatgggtctgtccagtcaaaatggtcagctgagaggccctgtgaaacccactggtggccctggaggagggggcacacagacacagcaacagatgaaccagctgaaaaacaccaacacaatcaataatggcactcagcagcaagcacagagtatgaccaccactattaaacctggtgatgactggaaaaagactttaaaactccctccaaaggatctaagaatcaaaacttcggatgtgacctccacaaaaggaaatgagtttgaagattactgtttgaaacgggagttactgatgggaatttttgaaatgggctgggaaaagccatctcctattcaggaggagagcattcccattgctttatctggtagggatatcttagctagagcaaaaaatggaacaggcaagagcggtgcctacctcattcccttacttgaacggctagacctgaagaaggacaatatacaagcaatggtgattgttcccactagagaacttgctctacaggtcagtcaaatttgcatccaggtcagcaaacacatgggaggggccaaagtgatggcaaccacaggaggaaccaatttacgagatgacataatgaggcttgatgatacagtgcacgtggtgattgctacccctgggagaatcctggatcttattaagaaaggagtagcaaaggttgatcatgtccagatgatagtattggatgaggcagataagttgctgtcacaggattttgtgcagataatggaggatattattctcacgctacctaaaaacaggcagattttactatattccgctactttccctcttagtgtacagaagttcatgaattcccatttgcagaaaccctatgagattaacctgatggaggaactaactctgaagggagtaacccagtactacgcatatgtaactgagcgccaaaaagtacactgcctcaacacacttttctccaggcttcagataaaccagtcgatcattttctgtaactcctctcagcgagttgaattgctagccaagaagatttctcaactgggttattcttgcttctatattcatgctaaaatgaggcaggaacatcgaaatcgtgtatttcatgatttccgaaatggcttatgccgcaatcttgtttgcactgatctgtttacccgaggtattgatatacaagctgtgaatgtggtaataaactttgatttcccaaagctggcagagacctatctccatcgtattggaagatcaggtcgctttggtcatcttggcttagccatcaacttgatcacatatgatgatcgcttcaacctgaaaagtattgaggagcagctgggaacagaaattaaacctattccgagcaacattgataagagcctgtatgtggcagaataccacagcgagcctgtagaagatgagaaaccttaacaagcatgctttgacaaattacaaaaggctcgtttggatctgtgacacatcgttttggggggaatgctcttctctttgtgggtttttcatcttttattttggaactatgaagacttaaaagagctcagacattttctttttttaactggtgaagagaaaaaggctgaaaagaaggaatataccttttttgttccacttgtttgcactgtgtgctgactgaacattagttgcactaactgctggtttttaaaaaatgttttctggggaaaggggacaaggaaggaaaagaaagaagagaaggggagaaaccctaaaaagagaagaatcttaatgaacacacaagcttgtcaatgatttcaaaattctccaacagctgactctcgtgcatttcaacttctccctgattcctcatccgttttttaagcctgaagagcttattacttatttgtgcgaagtgccttatgctatgagaccattcagaatatcatcttttagacacagcccgaggaatcaacaatagtaactctttctttccgtttttttttctttttcttttaaaaaatgtctttttattttggtttcaggttgaagtctcttccctttctacccagtactcgagcccagggctagaagttgaaactcactagtaatgttaaacaccattttttttttctttttggggaggagttgatatgcaactgcagttcatccgcactgtaaatacatgtatttaaaaaaacaatcccaagtaaaaatttcttctgggctgagtagataaaaaacatcatcgctcccaaaggaaagagcagtctatcattgcaggagccatatgacaagcctttgtgctctatagcagacactaaagactgggttacatatgcctccagtagtagtatggcacttgatgtgtagacatgtcagagccttggccctctttcctctgtggcaaagcgtgtcccatagaaaattgggtgtgtatacttgtataaactttgtaaataagttttttttctgggttcatatatatatatatatatacatatatatatattttttttttggatgaaggttgctgggattaaggggattagagtgattatgggagcagctaaagatgagaggggctcagttttacgcaacactaaattctagaaagtactttggcctcgtgctgtagagagcagatttctatggtaccctgtgttagtaaaggggcccagaaatctgggatgtactgtttgctgccacactgtctcatctagtacctttggagtaggtttaccagagagagcaaggaagcttcaaaacattgataattcaagatttattttgagaagctctgattttgcttcttccccctttctaaaagtttgaggaatatttcaagctctgcaacagggggcaaagattaatctaccttgcagtgtaggaattctattgagtggcagtgtcattgagcagtatatatataaagcacagatttgcatttcagaatattagccagtaccagctttggtaatgttagcagttctggagcttaattttctgtggatcatttcctgtagtgtgtaaatgtgttgccctctgcccgctttgatacataaacttttgcaggaatgggcaacctgagagctgttaactttcatgctacagaaagctgcttgccattctcttgcattgtgacaagaattgttacctgtcattttgcactgtaaattgctggcagatgctttacagtcaatagtgttgctttaaattgtgcccctcccaacatgcttgatgtttggcctgatctccaggcaaaaggagtgagatgaatcaaaaccagtgaacttttttttttaatgtttttaattcccttttaacccagtgtactaggtcaatcaggaggcatctggaaagggggggaaaaaagcaaaaaacaaaattaaaaaaaattgatttccatattttttcaaaaccctaaaatattacaaaataagtcccgcatatactttaatgttttaactcttttggacaaaggaatcaattacttgaagttgcttttttgactctgcctacttctgagcaaactatttgcgactcacccacaattccttggagatcaaaatcctacagatgcctcctgatgggacatagccctaactccttaacaactgtagcaagaactgcacggtacaaacccaaaaaagaacaagctcatctatttggaacccaagcctcatattttctgtccagtcaatgttggttactaaatagaaaacctaattaaggaagtaacttttttccagggaggggtgggagagggaatttaaaaggtgtcaacttttgaccaaaaaaattgtgcccttgtaccgatgcagctctctttctcccccacctcttgcgagataagagggatcattcatgtagaagaaaagagtataaatgcaattctgtatctcgctagagaacgtgtgggtgactaaacaaaaagtgcagtctccttcaccaactttagactgcgtggtgccacatgcctgtgggtccctcttaaagcacagacttaaaatggaaagtattactgaagtatagcctctaatgaggagtggcacttaaactatctgggacaccactactggacacggtcttgtagaggcagctgtccagttttggtgcttgactcttgaataggaattgttaaatggaaagatgctctgagtgactaggtcaaagcctggtcttttttttttt

SEQ ID NO: 72908 - DNA, 4404 bp, Homo sapiens
agcgggaggcggcgggcgggcgaacgggcgagcgagggagggggcagaggagccgagttagctcagccaggcggcgacttcggcggcgccacgagagcgggcagcggaggagattgacgtgagtgaattcagatataactcaagcttgttagagggctttttaaaaataaaaagttgattccgtgcaagagagcaagttactgctgcttaccgttcagagacttacaggtgcttgcctgcattgcaataaaggactcatttattgagcaagacttatatttatctcttcattttggagagcctaataaactgttattacagtttctctactgactttcaaaagttttgaagtttgaaagacctttgcaattaaaacagcatgagcacggccagaacagagaaccctgttataatgggtctgtccagtcaaaatggtcagctgagaggccctgtgaaacccactggtggccctggaggagggggcacacagacacagcaacagatgaaccagctgaaaaacaccaacacaatcaataatggcactcagcagcaagcacagagtatgaccaccactattaaacctggtgatgactggaaaaagactttaaaactccctccaaaggatctaagaatcaaaacttcggatgtgacctccacaaaaggaaatgagtttgaagattactgtttgaaacgggagttactgatgggaatttttgaaatgggctgggaaaagccatctcctattcaggaggagagcattcccattgctttatctggtagggatatcttagctagagcaaaaaatggaacaggcaagagcggtgcctacctcattcccttacttgaacggctagacctgaagaaggacaatatacaagcaatggtgattgttcccactagagaacttgctctacaggtcagtcaaatttgcatccaggtcagcaaacacatgggaggggccaaagtgatggcaaccacaggaggaaccaatttacgagatgacataatgaggcttgatgatacagtgcacgtggtgattgctacccctgggagaatcctggatcttattaagaaaggagtagcaaaggttgatcatgtccagatgatagtattggatgaggcagataagttgctgtcacaggattttgtgcagataatggaggatattattctcacgctacctaaaaacaggcagattttactatattccgctactttccctcttagtgtacagaagttcatgaattcccatttgcagaaaccctatgagattaacctgatggaggaactaactctgaagggagtaacccagtactacgcatatgtaactgagcgccaaaaagtacactgcctcaacacacttttctccaggcttcagataaaccagtcgatcattttctgtaactcctctcagcgagttgaattgctagccaagaagatttctcaactgggttattcttgcttctatattcatgctaaaatgaggcaggaacatcgaaatcgtgtatttcatgatttccgaaatggcttatgccgcaatcttgtttgcactgatctgtttacccgaggtattgatatacaagctgtgaatgtggtaataaactttgatttcccaaagctggcagagacctatctccatcgtattggaagatcaggtcgctttggtcatcttggcttagccatcaacttgatcacatatgatgatcgcttcaacctgaaaagtattgaggagcagctgggaacagaaattaaacctattccgagcaacattgataagagcctgtatgtggcagaataccacagcgagcctgtagaagatgagaaaccttaacaagcatgctttgacaaattacaaaaggctcgtttggatctgtgacacatcgttttggggggaatgctcttctctttgtgggtttttcatcttttattttggaactatgaagacttaaaagagctcagacattttctttttttaactggtgaagagaaaaaggctgaaaagaaggaatataccttttttgttccacttgtttgcactgtgtgctgactgaacattagttgcactaactgctggtttttaaaaaatgttttctggggaaaggggacaaggaaggaaaagaaagaagagaaggggagaaaccctaaaaagagaagaatcttaatgaacacacaagcttgtcaatgatttcaaaattctccaacagctgactctcgtgcatttcaacttctccctgattcctcatccgttttttaagcctgaagagcttattacttatttgtgcgaagtgccttatgctatgagaccattcagaatatcatcttttagacacagcccgaggaatcaacaatagtaactctttctttccgtttttttttctttttcttttaaaaaatgtctttttattttggtttcaggttgaagtctcttccctttctacccagtactcgagcccagggctagaagttgaaactcactagtaatgttaaacaccattttttttttctttttggggaggagttgatatgcaactgcagttcatccgcactgtaaatacatgtatttaaaaaaacaatcccaagtaaaaatttcttctgggctgagtagataaaaaacatcatcgctcccaaaggaaagagcagtctatcattgcaggagccatatgacaagcctttgtgctctatagcagacactaaagactgggttacatatgcctccagtagtagtatggcacttgatgtgtagacatgtcagagccttggccctctttcctctgtggcaaagcgtgtcccatagaaaattgggtgtgtatacttgtataaactttgtaaataagttttttttctgggttcatatatatatatatatatacatatatatatattttttttttggatgaaggttgctgggattaaggggattagagtgattatgggagcagctaaagatgagaggggctcagttttacgcaacactaaattctagaaagtactttggcctcgtgctgtagagagcagatttctatggtaccctgtgttagtaaaggggcccagaaatctgggatgtactgtttgctgccacactgtctcatctagtacctttggagtaggtttaccagagagagcaaggaagcttcaaaacattgataattcaagatttattttgagaagctctgattttgcttcttccccctttctaaaagtttgaggaatatttcaagctctgcaacagggggcaaagattaatctaccttgcagtgtaggaattctattgagtggcagtgtcattgagcagtatatatataaagcacagatttgcatttcagaatattagccagtaccagctttggtaatgttagcagttctggagcttaattttctgtggatcatttcctgtagtgtgtaaatgtgttgccctctgcccgctttgatacataaacttttgcaggaatgggcaacctgagagctgttaactttcatgctacagaaagctgcttgccattctcttgcattgtgacaagaattgttacctgtcattttgcactgtaaattgctggcagatgctttacagtcaatagtgttgctttaaattgtgcccctcccaacatgcttgatgtttggcctgatctccaggcaaaaggagtgagatgaatcaaaaccagtgaacttttttttttaatgtttttaattcccttttaacccagtgtactaggtcaatcaggaggcatctggaaagggggggaaaaaagcaaaaaacaaaattaaaaaaaattgatttccatattttttcaaaaccctaaaatattacaaaataagtcccgcatatactttaatgttttaactcttttggacaaaggaatcaattacttgaagttgcttttttgactctgcctacttctgagcaaactatttgcgactcacccacaattccttggagatcaaaatcctacagatgcctcctgatgggacatagccctaactccttaacaactgtagcaagaactgcacggtacaaacccaaaaaagaacaagctcatctatttggaacccaagcctcatattttctgtccagtcaatgttggttactaaatagaaaacctaattaaggaagtaacttttttccagggaggggtgggagagggaatttaaaaggtgtcaacttttgaccaaaaaaattgtgcccttgtaccgatgcagctctctttctcccccacctcttgcgagataagagggatcattcatgtagaagaaaagagtataaatgcaattctgtatctcgctagagaacgtgtagaaattgtacggcttgtattcgggggctttgtatgattatgggcgttgagtagtagtagtgactggttgacattctgtgactggtgtagcaattgaccaggtactacaagatca

SEQ ID NO: 72909 - DNA, 1833 bp, Homo sapiens
gcccgtggggccctttttaagcgccagactttaaatgggaagtattactggagtattagcctcttatgaggggtggcactttaactatctggggcacccactactggacccggtcttgtagaggccagctgtcccgttttggtgcttgactcttgaattagggattgttaaatgggaagatagctctgaggactaggtccaagcccggtctttttttttttttttttttttttttttttctttcttttttgggccctcataataagcattgttactattggaagttgttttcacattctttccaatattaaatatgtatttttttaagtaatgataatattttccagtggctcatttggatgagaactaccctctatttttaatattaaaactacatccaactcatcatttagcctttggttgtacagttgtgtaatgggctatggactgttacacaccttaccacctctaggcctatgttttttctttccccatatattctgatggggataaatactgttttgcctctcccataggaatggaatacatttattctaaaatgatctttcacagaagtaagagagagggaaacctaaatatacctctaaattgtttgaagttggtcccagcagcataaaatgggttggccccaaagggttggagggtgggcttggttatcagtatttgttttcagaatgagatgggagcatctttcctttgccacgtgctttgtgcttgataacatcatgcttggttcaaacgacaactcagcacaaagccttgagtataaattgttggaatcaaaacatctcattctgatgacgtggtttaattttttaatttttttttttaataggggtgggagggagggtactttgccccaaaagggagggtgtctgcactaaggatttagaaacactttggaagctcataacctcatcagaaactgcctttagccacactcctgaccttctagatgagtaacaaaaaaatgaaataagttcttggaaattaagccatttattttaatttgctatttttttcaatgttctaggtatctttaaatttgttattgtggaatcattttcctgccagatacctttatcaaaattattggcctcatgagagctgaagtaagtcagctttttggtgaactttagtggacttctgtgagattgtagttgtactttgtatctctaaatctaaagatagttttttaaaactcccaaagaaaatctgctctcctttctgatctaaaaactcatctttggggtaaagagttaagtgtccaaaggttgtcacagttcatgaggtcagagggagctagcctggcacctggactctgcccatccacagctgacagattccaacagaagtgtatttaaattctccagtagacaatgctgggtaagggagggggtagggctgggttattaagatacaggctgctgtattttacattggttgtgggggaaggggagcctggagaaaacaaagtcactattcccttttttgaaacaggaaaaaaaattattttttgttcagtaaaaatggtagagaattccaatgtccctagccacaagggaccagttccactgagaagtgaacagtgggaactcaaaatttcagaaacattgggggaagggaaaattggctttctcttaattggcagatgttccagtggggggggggggctctgtttttgttgggatgtgttatgttgtatgtacgcatatatggaccggagtctgctgagtttataaggttccaaaaatatggtaaaatcttggtttttgttaatttatctcaataaaagcccactggaactccaaa

SEQ ID NO: 72910 - DNA, 1963 bp, Homo sapiens
  misc_feature (1849)..(1849): n is a, c, g, or t
gcccgtggggccctttttaagcgccagactttaaatgggaagtattactggagtattagcctcttatgaggggtggcactttaactatctggggcacccactactggacccggtcttgtagaggccagctgtcccgttttggtgcttgactcttgaattagggattgttaaatgggaagatagctctgaggactaggtccaagcccggtctttttttttttttttttttttttttttttctttcttttttgggccctcataataagcattgttactattggaagttgttttcacattctttccaatattaaatatgtatttttttaagtaatgataatattttccagtggctcatttggatgagaactaccctctatttttaatattaaaactacatccaactcatcatttagcctttggttgtacagttgtgtaatgggctatggactgttacacaccttaccacctctaggcctatgttttttctttccccatatattctgatggggataaatactgttttgcctctcccataggaatggaatacatttattctaaaatgatctttcacagaagtaagagagagggaaacctaaatatacctctaaattgtttgaagttggtcccagcagcataaaatgggttggccccaaagggttggagggtgggcttggttatcagtatttgttttcagaatgagatgggagcatctttcctttgccacgtgctttgtgcttgataacatcatgcttggttcaaacgacaactcagcacaaagccttgagtataaattgttggaatcaaaacatctcattctgatgacgtggtttaattttttaatttttttttttaataggggtgggagggagggtactttgccccaaaagggagggtgtctgcactaaggatttagaaacactttggaagctcataacctcatcagaaactgcctttagccacactcctgaccttctagatgagtaacaaaaaaatgaaataagttcttggaaattaagccatttattttaatttgctatttttttcaatgttctaggtatctttaaatttgttattgtggaatcattttcctgccagatacctttatcaaaattattggcctcatgagagctgaagtaagtcagctttttggtgaactttagtggacttctgtgagattgtagttgtactttgtatctctaaatctaaagatagttttttaaaactcccaaagaaaatctgctctcctttctgatctaaaaactcatctttggggtaaagagttaagtgtccaaaggttgtcacagttcatgaggtcagagggagctagcctggcacctggactctgcccatccacagctgacagattccaacagaagtgtatttaaattctccagtagacaatgctgggtaagggagggggtagggctgggttattaagatacaggctgctgtattttacattggttgtgggggaaggggagcctggagaaaacaaagtcactattcccttttttgaaacaggaaaaaaaattattttttgttcagtaaaaatggtagagaattccaatgtccctagccacaagggaccagttccactgagaagtgaacagtgggaactcaaaatttcagaaacattgggggaagggaaaattggctttctcttaattggcagatgttccagtggggggggggggctctgtttttgttgggatgtgttatgttgtatgtacgcatatatggaccggagtctgctgagtttataaggttccaaaaatatggtaaaatcttggtttttgttaatttatctcaataaaagcccactggaactccaaaaaaaaaaaaaaaaaanaaattgggggggccgcgaccaagaaagtttcaaacatctgggggcggcccaagtaagaacgtgtacgctccaggaaccggcagactggggtttcccaaaaagcgggggcgggtg

SEQ ID NO: 72911 - DNA, 2075 bp, Homo sapiens
gcccgtggggccctttttaagcgccagactttaaatgggaagtattactggagtattagcctcttatgaggggtggcactttaactatctggggcacccactactggacccggtcttgtagaggccagctgtcccgttttggtgcttgactcttgaattagggattgttaaatgggaagatagctctgaggactaggtccaagcccggtctttttttttttttttttttttttttttttctttcttttttgggccctcataataagcattgttactattggaagttgttttcacattctttccaatattaaatatgtatttttttaagtaatgataatattttccagtggctcatttggatgagaactaccctctatttttaatattaaaactacatccaactcatcatttagcctttggttgtacagttgtgtaatgggctatggactgttacacaccttaccacctctaggcctatgttttttctttccccatatattctgatggggataaatactgttttgcctctcccataggaatggaatacatttattctaaaatgatctttcacagaagtaagagagagggaaacctaaatatacctctaaattgtttgaagttggtcccagcagcataaaatgggttggccccaaagggttggagggtgggcttggttatcagtatttgttttcagaatgagatgggagcatctttcctttgccacgtgctttgtgcttgataacatcatgcttggttcaaacgacaactcagcacaaagccttgagtataaattgttggaatcaaaacatctcattctgatgacgtggtttaattttttaatttttttttttaataggggtgggagggagggtactttgccccaaaagggagggtgtctgcactaaggatttagaaacactttggaagctcataacctcatcagaaactgcctttagccacactcctgaccttctagatgagtaacaaaaaaatgaaataagttcttggaaattaagccatttattttaatttgctatttttttcaatgttctaggtatctttaaatttgttattgtggaatcattttcctgccagatacctttatcaaaattattggcctcatgagagctgaagtaagtcagctttttggtgaactttagtggacttctgtgagattgtagttgtactttgtatctctaaatctaaagatagttttttaaaactcccaaagaaaatctgctctcctttctgatctaaaaactcatctttggggtaaagagttaagtgtccaaaggttgtcacagttcatgaggtcagagggagctagcctggcacctggactctgcccatccacagctgacagattccaacagaagtgtatttaaattctccagtagacaatgctgggtaagggagggggtagggctgggttattaagatacaggctgctgtattttacattggttgtgggggaaggggagcctggagaaaacaaagtcactattcccttttttgaaacaggaaaaaaaattattttttgttcagtaaaaatggtagagaattccaatgtccctagccacaagggaccagttccactgagaagtgaacagtgggaactcaaaatttcagaaacattgggggaagggaaaattggctttctcttaattggcagatgttccagtggggggggggggctctgtttttgttgggatgtgttatgttgtatgtacgcatatatggaccggagtctgctgagtttataaggttccaaaaatatggtaaaatcttggtttttgttaatttatctcaataaaagcccactggaactccaaaaaaaaaaacaacacagacaacaaatacccccaaaccaaacaacaagaaaacacaaaacacagcgcagaaattaattgccgcgcgcggcaaaaaaaccgatacaacgaggcccccggcgtaacaaggctccgacggaagcagactactgacgacaaggggaggaacaacgggcgacaccactagagagagagctaaacacacgacaccccgagtctcggctataataagaaaaacaaccagag

SEQ ID NO: 72912 - DNA, 1383 bp, Homo sapiens
ctctcatttaacttttttaatgggtctcaaaattctgtgacaaattttggtcaagtgtttccattaaaaagtactgattttaaaaactaataacttaaaactgccacacgcaaaaaaagaaaaccaaagtggtccacaaaacattctcctttccttctgaaggttttacgatgcattgttatcattaaccagtcttttactactaaacttaaatggccaattgaaacaaacagttctgagaccgttcttccaccactgattaagagtggggtggcaggtattagggataatattcatttagccttctgagctttctgggcagacttggtgaccttgcccagctccagcagccttcttgtccactgctttgatgacacccaccgcaactgtctgtctcatatcacgaacagcaaagagacccaaaggtggattagtcttgagaagctctcaacacacatgggcttgaggaaccatatcaacaatggcagcacgagaaacgcctttagccacactcctgaccttctagatgagtaacaaaaaaatgaaataagttcttggaaattaagccatttattttaatttgctatttttttcaatgttctaggtatctttaaatttgttattgtggaatcattttcctgccagatacctttatcaaaattattggcctcatgagagctgaagtaagtcagctttttggtgaactttagtggacttctgtgagattgtagttgtactttgtatctctaaatctaaagatagttttttaaaactcccaaagaaaatctgctctcctttctgatctaaaaactcatctttggggtaaagagttaagtgtccaaaggttgtcacagttcatgaggtcagagggagctagcctggcacctggactctgcccatccacagctgacagattccaacagaagtgtatttaaattctccagtagacaatgctgggtaagggagggggtagggctgggttattaagatacaggctgctgtattttacattggttgtgggggaaggggagcctggagaaaacaaagtcactattcccttttttgaaacaggaaaaaaaattattttttgttcagtaaaaatggtagagaattccaatgtccctagccacaagggaccagttccactgagaagtgaacagtgggaactcaaaatttcagaaacattgggggaagggaaaattggctttctcttaattggcagatgttccagtggggggggggggctctgtttttgttgggatgtgttatgttgtatgtacgcatatatggaccggagtctgctgagtttataaggttccaaaaatatggtaaaatcttggtttttgttaatttatctcaataaaagcccactggaactccaaa

SEQ ID NO: 72913 - DNA, 3764 bp, Homo sapiens
agcgggaggcggcgggcgggcgaacgggcgagcgagggagggggcagaggagccgagttagctcagccaggcggcgacttcggcggcgccacgagagcgggcagcggaggagattgacgtgagtgaattcagatataactcaagcttgttagagggctttttaaaaataaaaagttgattccgtgcaagagagcaagttactgctgcttaccgttcagagacttacaggtgcttgcctgcattgcaataaaggactcatttattgagcaagacttatatttatctcttcattttggagagcctaataaactgttattacagtttctctactgactttcaaaagttttgaagtttgaaagacctttgcaattaaaacagcatgagcacggccagaacagagaaccctgttataatgggtctgtccagtcaaaatggtcagctgagaggccctgtgaaacccactggtggccctggaggagggggcacacagacacagcaacagatgaaccagctgaaaaacaccaacacaatcaataatggcactcagcagcaagcacagagtatgaccaccactattaaacctggtgatgactggaaaaagactttaaaactccctccaaaggatctaagaatcaaaacttcggatgtgacctccacaaaaggaaatgagtttgaagattactgtttgaaacgggagttactgatgggaatttttgaaatgggctgggaaaagccatctcctattcaggaggagagcattcccattgctttatctggtagggatatcttagctagagcaaaaaatggaacaggcaagagcggtgcctacctcattcccttacttgaacggctagacctgaagaaggacaatatacaagcaatggtgattgttcccactagagaacttgctctacaggtcagtcaaatttgcatccaggtcagcaaacacatgggaggggccaaagtgatggcaaccacaggaggaaccaatttacgagatgacataatgaggcttgatgatacagtgcacgtggtgattgctacccctgggagaatcctggatcttattaagaaaggagtagcaaaggttgatcatgtccagatgatagtattggatgaggcagataagttgctgtcacaggattttgtgcagataatggaggatattattctcacgctacctaaaaacaggcagattttactatattccgctactttccctcttagtgtacagaagttcatgaattcccatttgcagaaaccctatgagattaacctgatggaggaactaactctgaagggagtaacccagtactacgcatatgtaactgagcgccaaaaagtacactgcctcaacacacttttctccaggcttcagataaaccagtcgatcattttctgtaactcctctcagcgagttgaattgctagccaagaagatttctcaactgggttattcttgcttctatattcatgctaaaatgaggcaggaacatcgaaatcgtgtatttcatgatttccgaaatggcttatgccgcaatcttgtttgcactgatctgtttacccgaggtattgatatacaagctgtgaatgtggtaataaactttgatttcccaaagctggcagagacctatctccatcgtattggaagatcaggtcgctttggtcatcttggcttagccatcaacttgatcacatatgatgatcgcttcaacctgaaaagtattgaggagcagctgggaacagaaattaaacctattccgagcaacattgataagagcctgtatgtggcagaataccacagcgagcctgtagaagatgagaaaccttaacaagcatgctttgacaaattacaaaaggctcgtttggatctgtgacacatcgttttggggggaatgctcttctctttgtgggtttttcatcttttattttggaactatgaagacttaaaagagctcagacattttctttttttaactggtgaagagaaaaaggctgaaaagaaggaatataccttttttgttccacttgtttgcactgtgtgctgactgaacattagttgcactaactgctggtttttaaaaaatgttttctggggaaaggggacaaggaaggaaaagaaagaagagaaggggagaaaccctaaaaagagaagaatcttaatgaacacacaagcttgtcaatgatttcaaaattctccaacagctgactctcgtgcatttcaacttctccctgattcctcatccgttttttaagcctgaagagcttattacttatttgtgcgaagtgccttatgctatgagaccattcagaatatcatcttttagacacagcccgaggaatcaacaatagtaactctttctttccgtttttttttctttttcttttaaaaaatgtctttttattttggtttcaggttgaagtctcttccctttctacccagtactcgagcccagggctagaagttgaaactcactagtaatgttaaacaccattttttttttctttttggggaggagttgatatgcaactgcagttcatccgcactgtaaatacatgtatttaaaaaaacaatcccaagtaaaaatttcttctgggctgagtagataaaaaacatcatcgctcccaaaggaaagagcagtctatcattgcaggagccatatgacaagcctttgtgctctatagcagacactaaagactgggttacatatgcctccagtagtagtatggcacttgatgtgtagacatgtcagagccttggccctctttcctctgtggcaaagcgtgtcccatagaaaattgggtgtgtatacttgtataaactttgtaaataagttttttttctgggttcatatatatatatatatatacatatatatatattttttttttggatgaaggttgctgggattaaggggattagagtgattatgggagcagctaaagatgagaggggctcagttttacgcaacactaaattctagaaagtactttggcctcgtgctgtagagagcagatttctatggtaccctgtgttagtaaaggggcccagaaatctgggatgtactgtttgctgccacactgtctcatctagtacctttggagtaggtttaccagagagagcaaggaagcttcaaaacattgataattcaagatttattttgagaagctctgattttgcttcttccccctttctaaaagtttgaggaatatttcaagctctgcaacagggggcaaagattaatctaccttgcagtgtaggaattctattgagtggcagtgtcattgagcagtatatatataaagcacagatttgcatttcagaatattagccagtaccagctttggtaatgttagcagttctggagcttaattttctgtggatcatttcctgtagtgtgtaaatgtgttgccctctgcccgctttgatacataaacttttgcaggaatgggcaacctgagagctgttaactttcatgctacagaaagctgcttgccattctcttgcattgtgacaagaattgttacctgtcattttgcactgtaaattgctggcagatgctttacagtcaatagtgttgctttaaattgtgcccctcccaacatgcttgatgtttggcctgatctccaggcaaaaggagtgagatgaatcaaaaccagtgaacttttttttttaatgtttttaattcccttttaacccagtgtactaggtcaatcaggaggcatctcactcctttgcctggagatcaggccaaacataggatc

SEQ ID NO: 72914 - DNA, 3606 bp, Homo sapiens
agcgggaggcggcgggcgggcgaacgggcgagcgagggagggggcagaggagccgagttagctcagccaggcggcgacttcggcggcgccacgagagcgggcagcggaggagattgacgtgagtgaattcagatataactcaagcttgttagagggctttttaaaaataaaaagttgattccgtgcaagagagcaagttactgctgcttaccgttcagagacttacaggtgcttgcctgcattgcaataaaggactcatttattgagcaagacttatatttatctcttcattttggagagcctaataaactgttattacagtttctctactgactttcaaaagttttgaagtttgaaagacctttgcaattaaaacagcatgagcacggccagaacagagaaccctgttataatgggtctgtccagtcaaaatggtcagctgagaggccctgtgaaacccactggtggccctggaggagggggcacacagacacagcaacagatgaaccagctgaaaaacaccaacacaatcaataatggcactcagcagcaagcacagagtatgaccaccactattaaacctggtgatgactggaaaaagactttaaaactccctccaaaggatctaagaatcaaaacttcggatgtgacctccacaaaaggaaatgagtttgaagattactgtttgaaacgggagttactgatgggaatttttgaaatgggctgggaaaagccatctcctattcaggaggagagcattcccattgctttatctggtagggatatcttagctagagcaaaaaatggaacaggcaagagcggtgcctacctcattcccttacttgaacggctagacctgaagaaggacaatatacaagcaatggtgattgttcccactagagaacttgctctacaggtcagtcaaatttgcatccaggtcagcaaacacatgggaggggccaaagtgatggcaaccacaggaggaaccaatttacgagatgacataatgaggcttgatgatacagtgcacgtggtgattgctacccctgggagaatcctggatcttattaagaaaggagtagcaaaggttgatcatgtccagatgatagtattggatgaggcagataagttgctgtcacaggattttgtgcagataatggaggatattattctcacgctacctaaaaacaggcagattttactatattccgctactttccctcttagtgtacagaagttcatgaattcccatttgcagaaaccctatgagattaacctgatggaggaactaactctgaagggagtaacccagtactacgcatatgtaactgagcgccaaaaagtacactgcctcaacacacttttctccaggcttcagataaaccagtcgatcattttctgtaactcctctcagcgagttgaattgctagccaagaagatttctcaactgggttattcttgcttctatattcatgctaaaatgaggcaggaacatcgaaatcgtgtatttcatgatttccgaaatggcttatgccgcaatcttgtttgcactgatctgtttacccgaggtattgatatacaagctgtgaatgtggtaataaactttgatttcccaaagctggcagagacctatctccatcgtattggaagatcaggtcgctttggtcatcttggcttagccatcaacttgatcacatatgatgatcgcttcaacctgaaaagtattgaggagcagctgggaacagaaattaaacctattccgagcaacattgataagagcctgtatgtggcagaataccacagcgagcctgtagaagatgagaaaccttaacaagcatgctttgacaaattacaaaaggctcgtttggatctgtgacacatcgttttggggggaatgctcttctctttgtgggtttttcatcttttattttggaactatgaagacttaaaagagctcagacattttctttttttaactggtgaagagaaaaaggctgaaaagaaggaatataccttttttgttccacttgtttgcactgtgtgctgactgaacattagttgcactaactgctggtttttaaaaaatgttttctggggaaaggggacaaggaaggaaaagaaagaagagaaggggagaaaccctaaaaagagaagaatcttaatgaacacacaagcttgtcaatgatttcaaaattctccaacagctgactctcgtgcatttcaacttctccctgattcctcatccgttttttaagcctgaagagcttattacttatttgtgcgaagtgccttatgctatgagaccattcagaatatcatcttttagacacagcccgaggaatcaacaatagtaactctttctttccgtttttttttctttttcttttaaaaaatgtctttttattttggtttcaggttgaagtctcttccctttctacccagtactcgagcccagggctagaagttgaaactcactagtaatgttaaacaccattttttttttctttttggggaggagttgatatgcaactgcagttcatccgcactgtaaatacatgtatttaaaaaaacaatcccaagtaaaaatttcttctgggctgagtagataaaaaacatcatcgctcccaaaggaaagagcagtctatcattgcaggagccatatgacaagcctttgtgctctatagcagacactaaagactgggttacatatgcctccagtagtagtatggcacttgatgtgtagacatgtcagagccttggccctctttcctctgtggcaaagcgtgtcccatagaaaattgggtgtgtatacttgtataaactttgtaaataagttttttttctgggttcatatatatatatatatatacatatatatatattttttttttggatgaaggttgctgggattaaggggattagagtgattatgggagcagctaaagatgagaggggctcagttttacgcaacactaaattctagaaagtactttggcctcgtgctgtagagagcagatttctatggtaccctgtgttagtaaaggggcccagaaatctgggatgtactgtttgctgccacactgtctcatctagtacctttggagtaggtttaccagagagagcaaggaagcttcaaaacattgataattcaagatttattttgagaagctctgattttgcttcttccccctttctaaaagtttgaggaatatttcaagctctgcaacagggggcaaagattaatctaccttgcagtgtaggaattctattgagtggcagtgtcattgagcagtatatatataaagcacagatttgcatttcagaatattagccagtaccagctttggtaatgttagcagttctggagcttaattttctgtggatcatttcctgtagtgtgtaaatgtgttgccctctgcccgctttgatacataaacttttgcaggaatgggcaacctgagagctgttaactttcatgctacagaaagctgcttgccattctcttgcattgtgacaagaattgttacctgtcattttgcactgtaaattgctggcagatgctttacagtcaatagtgttgccgtcgtgcctccgggatcctctgaa

SEQ ID NO: 72915 - DNA, 3572 bp, Homo sapiens
gcccgtggggccctttttaagcgccagactttaaatgggaagtattactggagtattagcctcttatgaggggtggcactttaactatctggggcacccactactggacccggtcttgtagaggccagctgtcccgttttggtgcttgactcttgaattagggattgttaaatgggaagatagctctgaggactaggtccaagcccggtctttttttttttttttttttttttttttttctttcttttttgggccctcataataagcattgttactattggaagttgttttcacattctttccaatattaaatatgtatttttttaagtaatgataatattttccagtggctcatttggatgagaactaccctctatttttaatattaaaactacatccaactcatcatttagcctttggttgtacagttgtgtaatgggctatggactgttacacaccttaccacctctaggcctatgttttttctttccccatatattctgatggggataaatactgttttgcctctcccataggaatggaatacatttattctaaaatgatctttcacagaagtaagagagagggaaacctaaatatacctctaaattgtttgaagttggtcccagcagcataaaatgggttggccccaaagggttggagggtgggcttggttatcagtatttgttttcagaatgagatgggagcatctttcctttgccacgtgctttgtgcttgataacatcatgcttggttcaaacgacaactcagcacaaagccttgagtataaattgttggaatcaaaacatctcattctgatgacgtggtttaattttttaatttttttttttaataggggtgggagggagggtactttgccccaaaagggagggtgtctgcactaaggatttagaaacactttggaagctcataacctcatcagaaactgcctttagccacactcctgaccttctagatgagtaacaaaaaaatgaaataagttcttggaaattaagccatttattttaatttgctatttttttcaatgttctaggtatctttaaatttgttattgtggaatcattttcctgccagatacctttatcaaaattattggcctcatgagagctgaagtaagtcagctttttggtgaactttagtggacttctgtgagattgtagttgtactttgtatctctaaatctaaagatagttttttaaaactcccaaagaaaatctgctctcctttctgatctaaaaactcatctttggggtaaagagttaagtgtccaaaggttgtcacagttcatgaggtcagagggagctagcctggcacctggactctgcccatccacagctgacagattccaacagaagttgccttatgctatgagaccattcagaatatcatcttttagacacagcccgaggaatcaacaatagtaactctttctttccgtttttttttctttttcttttaaaaaatgtctttttattttggtttcaggttgaagtctcttccctttctacccagtactcgagcccagggctagaagttgaaactcactagtaatgttaaacaccattttttttttctttttggggaggagttgatatgcaactgcagttcatccgcactgtaaatacatgtatttaaaaaaacaatcccaagtaaaaatttcttctgggctgagtagataaaaaacatcatcgctcccaaaggaaagagcagtctatcattgcaggagccatatgacaagcctttgtgctctatagcagacactaaagactgggttacatatgcctccagtagtagtatggcacttgatgtgtagacatgtcagagccttggccctctttcctctgtggcaaagcgtgtcccatagaaaattgggtgtgtatacttgtataaactttgtaaataagttttttttctgggttcatatatatatatatatatacatatatatatattttttttttggatgaaggttgctgggattaaggggattagagtgattatgggagcagctaaagatgagaggggctcagttttacgcaacactaaattctagaaagtactttggcctcgtgctgtagagagcagatttctatggtaccctgtgttagtaaaggggcccagaaatctgggatgtactgtttgctgccacactgtctcatctagtacctttggagtaggtttaccagagagagcaaggaagcttcaaaacattgataattcaagatttattttgagaagctctgattttgcttcttccccctttctaaaagtttgaggaatatttcaagctctgcaacagggggcaaagattaatctaccttgcagtgtaggaattctattgagtggcagtgtcattgagcagtatatatataaagcacagatttgcatttcagaatattagccagtaccagctttggtaatgttagcagttctggagcttaattttctgtggatcatttcctgtagtgtgtaaatgtgttgccctctgcccgctttgatacataaacttttgcaggaatgggcaacctgagagctgttaactttcatgctacagaaagctgcttgccattctcttgcattgtgacaagaattgttacctgtcattttgcactgtaaattgctggcagatgctttacagtcaatagtgttgctttaaattgtgcccctcccaacatgcttgatgtttggcctgatctccaggcaaaaggagtgagatgaatcaaaaccagtgaacttttttttttaatgtttttaattcccttttaacccagtgtactaggtcaatcaggaggcatctggaaagggggggaaaaaagcaaaaaacaaaattaaaaaaaattgatttccatattttttcaaaaccctaaaatattacaaaataagtcccgcatatactttaatgttttaactcttttggacaaaggaatcaattacttgaagttgcttttttgactctgcctacttctgagcaaactatttgcgactcacccacaattccttggagatcaaaatcctacagatgcctcctgatgggacatagccctaactccttaacaactgtagcaagaactgcacggtacaaacccaaaaaagaacaagctcatctatttggaacccaagcctcatattttctgtccagtcaatgttggttactaaatagaaaacctaattaaggaagtaacttttttccagggaggggtgggagagggaatttaaaaggtgtcaacttttgaccaaaaaaattgtgcccttgtaccgatgcagctctctttctcccccacctcttgcgagataagagggatcattcatgtagaagaaaagagtataaatgcaattctgtatctcgctagagaacgtgtgggtgactaaacaaaaagtgcagtctccttcaccaactttagactgcgtggtgccacatgcctgtgggtccctcttaaagcacagacttaaaatggaaagtattactgaagtatagcctctaatgaggagtggcacattatatctactccgtgtgacaaccatttcccgagctcatcctgttgccgcggtca

SEQ ID NO: 72916 - DNA, 4514 bp, Homo sapiens
tgctttgggggctgtggggagccccccgggccggctctgggggactctcgggcggaggcctaaggcctggccgggcctggggaggaaggcggtcggcagctgtgtggggtgggagcgcctgagaggaggcgaatataggaatgtgattgacgtgagtgaattcagatataactcaagcttgttagagggctttttaaaaataaaaagttgattccgtgcaagagagcaagttactgctgcttaccgttcagagacttacaggtgcttgcctgcattgcaataaaggactcatttattgagcaagacttatatttatctcttcattttggagagcctaataaactgttattacagtttctctactgactttcaaaagttttgaagtttgaaagacctttgcaattaaaacagcatgagcacggccagaacagagaaccctgttataatgggtctgtccagtcaaaatggtcagctgagaggccctgtgaaacccactggtggccctggaggagggggcacacagacacagcaacagatgaaccagctgaaaaacaccaacacaatcaataatggcactcagcagcaagcacagagtatgaccaccactattaaacctggtgatgactggaaaaagactttaaaactccctccaaaggatctaagaatcaaaacttcggatgtgacctccacaaaaggaaatgagtttgaagattactgtttgaaacgggagttactgatgggaatttttgaaatgggctgggaaaagccatctcctattcaggaggagagcattcccattgctttatctggtagggatatcttagctagagcaaaaaatggaacaggcaagagcggtgcctacctcattcccttacttgaacggctagacctgaagaaggacaatatacaagcaatggtgattgttcccactagagaacttgctctacaggtcagtcaaatttgcatccaggtcagcaaacacatgggaggggccaaagtgatggcaaccacaggaggaaccaatttacgagatgacataatgaggcttgatgatacagtgcacgtggtgattgctacccctgggagaatcctggatcttattaagaaaggagtagcaaaggttgatcatgtccagatgatagtattggatgaggcagataagttgctgtcacaggattttgtgcagataatggaggatattattctcacgctacctaaaaacaggcagattttactatattccgctactttccctcttagtgtacagaagttcatgaattcccatttgcagaaaccctatgagattaacctgatggaggaactaactctgaagggagtaacccagtactacgcatatgtaactgagcgccaaaaagtacactgcctcaacacacttttctccaggcttcagataaaccagtcgatcattttctgtaactcctctcagcgagttgaattgctagccaagaagatttctcaactgggttattcttgcttctatattcatgctaaaatgaggcaggaacatcgaaatcgtgtatttcatgatttccgaaatggcttatgccgcaatcttgtttgcactgatctgtttacccgaggtattgatatacaagctgtgaatgtggtaataaactttgatttcccaaagctggcagagacctatctccatcgtattggaagatcaggtcgctttggtcatcttggcttagccatcaacttgatcacatatgatgatcgcttcaacctgaaaagtattgaggagcagctgggaacagaaattaaacctattccgagcaacattgataagagcctgtatgtggcagaataccacagcgagcctgtagaagatgagaaaccttaacaagcatgctttgacaaattacaaaaggctcgtttggatctgtgacacatcgttttggggggaatgctcttctctttgtgggtttttcatcttttattttggaactatgaagacttaaaagagctcagacattttctttttttaactggtgaagagaaaaaggctgaaaagaaggaatataccttttttgttccacttgtttgcactgtgtgctgactgaacattagttgcactaactgctggtttttaaaaaatgttttctggggaaaggggacaaggaaggaaaagaaagaagagaaggggagaaaccctaaaaagagaagaatcttaatgaacacacaagcttgtcaatgatttcaaaattctccaacagctgactctcgtgcatttcaacttctccctgattcctcatccgttttttaagcctgaagagcttattacttatttgtgcgaagtgccttatgctatgagaccattcagaatatcatcttttagacacagcccgaggaatcaacaatagtaactctttctttccgtttttttttctttttcttttaaaaaatgtctttttattttggtttcaggttgaagtctcttccctttctacccagtactcgagcccagggctagaagttgaaactcactagtaatgttaaacaccattttttttttctttttggggaggagttgatatgcaactgcagttcatccgcactgtaaatacatgtatttaaaaaaacaatcccaagtaaaaatttcttctgggctgagtagataaaaaacatcatcgctcccaaaggaaagagcagtctatcattgcaggagccatatgacaagcctttgtgctctatagcagacactaaagactgggttacatatgcctccagtagtagtatggcacttgatgtgtagacatgtcagagccttggccctctttcctctgtggcaaagcgtgtcccatagaaaattgggtgtgtatacttgtataaactttgtaaataagttttttttctgggttcatatatatatatatatatacatatatatatattttttttttggatgaaggttgctgggattaaggggattagagtgattatgggagcagctaaagatgagaggggctcagttttacgcaacactaaattctagaaagtactttggcctcgtgctgtagagagcagatttctatggtaccctgtgttagtaaaggggcccagaaatctgggatgtactgtttgctgccacactgtctcatctagtacctttggagtaggtttaccagagagagcaaggaagcttcaaaacattgataattcaagatttattttgagaagctctgattttgcttcttccccctttctaaaagtttgaggaatatttcaagctctgcaacagggggcaaagattaatctaccttgcagtgtaggaattctattgagtggcagtgtcattgagcagtatatatataaagcacagatttgcatttcagaatattagccagtaccagctttggtaatgttagcagttctggagcttaattttctgtggatcatttcctgtagtgtgtaaatgtgttgccctctgcccgctttgatacataaacttttgcaggaatgggcaacctgagagctgttaactttcatgctacagaaagctgcttgccattctcttgcattgtgacaagaattgttacctgtcattttgcactgtaaattgctggcagatgctttacagtcaatagtgttgctttaaattgtgcccctcccaacatgcttgatgtttggcctgatctccaggcaaaaggagtgagatgaatcaaaaccagtgaacttttttttttaatgtttttaattcccttttaacccagtgtactaggtcaatcaggaggcatctggaaagggggggaaaaaagcaaaaaacaaaattaaaaaaaattgatttccatattttttcaaaaccctaaaatattacaaaataagtcccgcatatactttaatgttttaactcttttggacaaaggaatcaattacttgaagttgcttttttgactctgcctacttctgagcaaactatttgcgactcacccacaattccttggagatcaaaatcctacagatgcctcctgatgggacatagccctaactccttaacaactgtagcaagaactgcacggtacaaacccaaaaaagaacaagctcatctatttggaacccaagcctcatattttctgtccagtcaatgttggttactaaatagaaaacctaattaaggaagtaacttttttccagggaggggtgggagagggaatttaaaaggtgtcaacttttgaccaaaaaaattgtgcccttgtaccgatgcagctctctttctcccccacctcttgcgagataagagggatcattcatgtagaagaaaagagtataaatgcaattctgtatctcgctagagaacgtgtgggtgactaaacaaaaagtgcagtctccttcaccaactttagactgcgtggtgccacatgcctgtgggtccctcttaaagcacagacttaaaatggaaagtattactgaagtatagcctctaatgaggagtggcacattatatctactccgtgtgacaaccatttcccgagctcatcctgttgccgcggtca

SEQ ID NO: 72917 - DNA, 3932 bp, Homo sapiens
  misc_feature (85)..(85): n is a, c, g, or t
  misc_feature (94)..(94): n is a, c, g, or t
tttaaggctagggatgctgtatagtcccattagaaagctttttttcttaactgcacttagatttgttgtcctttttattactgcnccgcccccnccaaaaaatttctggtctgtctttagcttcatttctgaacattttatcttggcctcccagagtgctgggattacaggcgtgagccactgcatcataaggtgcagttacaggtgtgagccactgcatcataaggcgcagtatttctatagcttcttaaattttgtaaataatgatgtatagcatgttctcccacctcaccccatattttcttatatattccttgatactgtttcagcaatggtgattgttcccactagagaacttgctctacaggtcagtcaaatttgcatccaggtcagcaaacacatgggaggggccaaagtgatggcaaccacaggaggaaccaatttacgagatgacataatgaggcttgatgatacagtgcacgtggtgattgctacccctgggagaatcctggatcttattaagaaaggagtagcaaaggttgatcatgtccagatgatagtattggatgaggcagataagttgctgtcacaggattttgtgcagataatggaggatattattctcacgctacctaaaaacaggcagattttactatattccgctactttccctcttagtgtacagaagttcatgaattcccatttgcagaaaccctatgagattaacctgatggaggaactaactctgaagggagtaacccagtactacgcatatgtaactgagcgccaaaaagtacactgcctcaacacacttttctccaggcttcagataaaccagtcgatcattttctgtaactcctctcagcgagttgaattgctagccaagaagatttctcaactgggttattcttgcttctatattcatgctaaaatgaggcaggaacatcgaaatcgtgtatttcatgatttccgaaatggcttatgccgcaatcttgtttgcactgatctgtttacccgaggtattgatatacaagctgtgaatgtggtaataaactttgatttcccaaagctggcagagacctatctccatcgtattggaagatcaggtcgctttggtcatcttggcttagccatcaacttgatcacatatgatgatcgcttcaacctgaaaagtattgaggagcagctgggaacagaaattaaacctattccgagcaacattgataagagcctgtatgtggcagaataccacagcgagcctgtagaagatgagaaaccttaacaagcatgctttgacaaattacaaaaggctcgtttggatctgtgacacatcgttttggggggaatgctcttctctttgtgggtttttcatcttttattttggaactatgaagacttaaaagagctcagacattttctttttttaactggtgaagagaaaaaggctgaaaagaaggaatataccttttttgttccacttgtttgcactgtgtgctgactgaacattagttgcactaactgctggtttttaaaaaatgttttctggggaaaggggacaaggaaggaaaagaaagaagagaaggggagaaaccctaaaaagagaagaatcttaatgaacacacaagcttgtcaatgatttcaaaattctccaacagctgactctcgtgcatttcaacttctccctgattcctcatccgttttttaagcctgaagagcttattacttatttgtgcgaagtgccttatgctatgagaccattcagaatatcatcttttagacacagcccgaggaatcaacaatagtaactctttctttccgtttttttttctttttcttttaaaaaatgtctttttattttggtttcaggttgaagtctcttccctttctacccagtactcgagcccagggctagaagttgaaactcactagtaatgttaaacaccattttttttttctttttggggaggagttgatatgcaactgcagttcatccgcactgtaaatacatgtatttaaaaaaacaatcccaagtaaaaatttcttctgggctgagtagataaaaaacatcatcgctcccaaaggaaagagcagtctatcattgcaggagccatatgacaagcctttgtgctctatagcagacactaaagactgggttacatatgcctccagtagtagtatggcacttgatgtgtagacatgtcagagccttggccctctttcctctgtggcaaagcgtgtcccatagaaaattgggtgtgtatacttgtataaactttgtaaataagttttttttctgggttcatatatatatatatatatacatatatatatattttttttttggatgaaggttgctgggattaaggggattagagtgattatgggagcagctaaagatgagaggggctcagttttacgcaacactaaattctagaaagtactttggcctcgtgctgtagagagcagatttctatggtaccctgtgttagtaaaggggcccagaaatctgggatgtactgtttgctgccacactgtctcatctagtacctttggagtaggtttaccagagagagcaaggaagcttcaaaacattgataattcaagatttattttgagaagctctgattttgcttcttccccctttctaaaagtttgaggaatatttcaagctctgcaacagggggcaaagattaatctaccttgcagtgtaggaattctattgagtggcagtgtcattgagcagtatatatataaagcacagatttgcatttcagaatattagccagtaccagctttggtaatgttagcagttctggagcttaattttctgtggatcatttcctgtagtgtgtaaatgtgttgccctctgcccgctttgatacataaacttttgcaggaatgggcaacctgagagctgttaactttcatgctacagaaagctgcttgccattctcttgcattgtgacaagaattgttacctgtcattttgcactgtaaattgctggcagatgctttacagtcaatagtgttgctttaaattgtgcccctcccaacatgcttgatgtttggcctgatctccaggcaaaaggagtgagatgaatcaaaaccagtgaacttttttttttaatgtttttaattcccttttaacccagtgtactaggtcaatcaggaggcatctggaaagggggggaaaaaagcaaaaaacaaaattaaaaaaaattgatttccatattttttcaaaaccctaaaatattacaaaataagtcccgcatatactttaatgttttaactcttttggacaaaggaatcaattacttgaagttgcttttttgactctgcctacttctgagcaaactatttgcgactcacccacaattccttggagatcaaaatcctacagatgcctcctgatgggacatagccctaactccttaacaactgtagcaagaactgcacggtacaaacccaaaaaagaacaagctcatctatttggaacccaagcctcatattttctgtccagtcaatgttggttactaaatagaaaacctaattaaggaagtaacttttttccagggaggggtgggagagggaatttaaaaggtgtcaacttttgaccaaaaaaattgtgcccttgtaccgatgcagctctctttctcccccacctcttgcgagataagagggatcattcatgtagaagaaaagagtataaatgcaattctgtatctcgctagagaacgtgtgggtgactaaacaaaaagtgcagtctccttcaccaactttagactgcgtggtgccacatgcctgtgggtccctcttaaagcacagacttaaaatggaaagtattactgaagtatagcctctaatgaggagtggcacattatatctactccgtgtgacaaccatttcccgagctcatcctgttgccgcggtca

SEQ ID NO: 72918 - DNA, 3579 bp, Homo sapiens
ctgattacagaattgcgagctcaggtaccccgtgaccatttggacgcatgggaggggccaaagtgatggcaaccacaggaggaaccaatttacgagatgacataatgaggcttgatgatacagtgcacgtggtgattgctacccctgggagaatcctggatcttattaagaaaggagtagcaaaggttgatcatgtccagatgatagtattggatgaggcagataagttgctgtcacaggattttgtgcagataatggaggatattattctcacgctacctaaaaacaggcagattttactatattccgctactttccctcttagtgtacagaagttcatgaattcccatttgcagaaaccctatgagattaacctgatggaggaactaactctgaagggagtaacccagtactacgcatatgtaactgagcgccaaaaagtacactgcctcaacacacttttctccaggcttcagataaaccagtcgatcattttctgtaactcctctcagcgagttgaattgctagccaagaagatttctcaactgggttattcttgcttctatattcatgctaaaatgaggcaggaacatcgaaatcgtgtatttcatgatttccgaaatggcttatgccgcaatcttgtttgcactgatctgtttacccgaggtattgatatacaagctgtgaatgtggtaataaactttgatttcccaaagctggcagagacctatctccatcgtattggaagatcaggtcgctttggtcatcttggcttagccatcaacttgatcacatatgatgatcgcttcaacctgaaaagtattgaggagcagctgggaacagaaattaaacctattccgagcaacattgataagagcctgtatgtggcagaataccacagcgagcctgtagaagatgagaaaccttaacaagcatgctttgacaaattacaaaaggctcgtttggatctgtgacacatcgttttggggggaatgctcttctctttgtgggtttttcatcttttattttggaactatgaagacttaaaagagctcagacattttctttttttaactggtgaagagaaaaaggctgaaaagaaggaatataccttttttgttccacttgtttgcactgtgtgctgactgaacattagttgcactaactgctggtttttaaaaaatgttttctggggaaaggggacaaggaaggaaaagaaagaagagaaggggagaaaccctaaaaagagaagaatcttaatgaacacacaagcttgtcaatgatttcaaaattctccaacagctgactctcgtgcatttcaacttctccctgattcctcatccgttttttaagcctgaagagcttattacttatttgtgcgaagtgccttatgctatgagaccattcagaatatcatcttttagacacagcccgaggaatcaacaatagtaactctttctttccgtttttttttctttttcttttaaaaaatgtctttttattttggtttcaggttgaagtctcttccctttctacccagtactcgagcccagggctagaagttgaaactcactagtaatgttaaacaccattttttttttctttttggggaggagttgatatgcaactgcagttcatccgcactgtaaatacatgtatttaaaaaaacaatcccaagtaaaaatttcttctgggctgagtagataaaaaacatcatcgctcccaaaggaaagagcagtctatcattgcaggagccatatgacaagcctttgtgctctatagcagacactaaagactgggttacatatgcctccagtagtagtatggcacttgatgtgtagacatgtcagagccttggccctctttcctctgtggcaaagcgtgtcccatagaaaattgggtgtgtatacttgtataaactttgtaaataagttttttttctgggttcatatatatatatatatatacatatatatatattttttttttggatgaaggttgctgggattaaggggattagagtgattatgggagcagctaaagatgagaggggctcagttttacgcaacactaaattctagaaagtactttggcctcgtgctgtagagagcagatttctatggtaccctgtgttagtaaaggggcccagaaatctgggatgtactgtttgctgccacactgtctcatctagtacctttggagtaggtttaccagagagagcaaggaagcttcaaaacattgataattcaagatttattttgagaagctctgattttgcttcttccccctttctaaaagtttgaggaatatttcaagctctgcaacagggggcaaagattaatctaccttgcagtgtaggaattctattgagtggcagtgtcattgagcagtatatatataaagcacagatttgcatttcagaatattagccagtaccagctttggtaatgttagcagttctggagcttaattttctgtggatcatttcctgtagtgtgtaaatgtgttgccctctgcccgctttgatacataaacttttgcaggaatgggcaacctgagagctgttaactttcatgctacagaaagctgcttgccattctcttgcattgtgacaagaattgttacctgtcattttgcactgtaaattgctggcagatgctttacagtcaatagtgttgctttaaattgtgcccctcccaacatgcttgatgtttggcctgatctccaggcaaaaggagtgagatgaatcaaaaccagtgaacttttttttttaatgtttttaattcccttttaacccagtgtactaggtcaatcaggaggcatctggaaagggggggaaaaaagcaaaaaacaaaattaaaaaaaattgatttccatattttttcaaaaccctaaaatattacaaaataagtcccgcatatactttaatgttttaactcttttggacaaaggaatcaattacttgaagttgcttttttgactctgcctacttctgagcaaactatttgcgactcacccacaattccttggagatcaaaatcctacagatgcctcctgatgggacatagccctaactccttaacaactgtagcaagaactgcacggtacaaacccaaaaaagaacaagctcatctatttggaacccaagcctcatattttctgtccagtcaatgttggttactaaatagaaaacctaattaaggaagtaacttttttccagggaggggtgggagagggaatttaaaaggtgtcaacttttgaccaaaaaaattgtgcccttgtaccgatgcagctctctttctcccccacctcttgcgagataagagggatcattcatgtagaagaaaagagtataaatgcaattctgtatctcgctagagaacgtgtgggtgactaaacaaaaagtgcagtctccttcaccaactttagactgcgtggtgccacatgcctgtgggtccctcttaaagcacagacttaaaatggaaagtattactgaagtatagcctctaatgaggagtggcacattatatctactccgtgtgacaaccatttcccgagctcatcctgttgccgcggtca

SEQ ID NO: 72919 - DNA, 2226 bp, Homo sapiens
  misc_feature (2214)..(2214): n is a, c, g, or t
agcgggaggcggcgggcgggcgaacgggcgagcgagggagggggcagaggagccgagttagctcagccaggcggcgacttcggcggcgccacgagagcgggcagcggaggagattgacgtgagtgaattcagatataactcaagcttgttagagggctttttaaaaataaaaagttgattccgtgcaagagagcaagttactgctgcttaccgttcagagacttacaggtgcttgcctgcattgcaataaaggactcatttattgagcaagacttatatttatctcttcattttggagagcctaataaactgttattacagtttctctactgactttcaaaagttttgaagtttgaaagacctttgcaattaaaacagcatgagcacggccagaacagagaaccctgttataatgggtctgtccagtcaaaatggtcagctgagaggccctgtgaaacccactggtggccctggaggagggggcacacagacacagcaacagatgaaccagctgaaaaacaccaacacaatcaataatggcactcagcagcaagcacagagtatgaccaccactattaaacctggtgatgactggaaaaagactttaaaactccctccaaaggatctaagaatcaaaacttcggatgtgacctccacaaaaggaaatgagtttgaagattactgtttgaaacgggagttactgatgggaatttttgaaatgggctgggaaaagccatctcctattcaggaggagagcattcccattgctttatctggtagggatatcttagctagagcaaaaaatggaacaggcaagagcggtgcctacctcattcccttacttgaacggctagacctgaagaaggacaatatacaagcaatggtgattgttcccactagagaacttgctctacaggtcagtcaaatttgcatccaggtcagcaaacacatgggaggggccaaagtgatggcaaccacaggaggaaccaatttacgagatgacataatgaggcttgatgatacagtgcacgtggtgattgctacccctgggagaatcctggatcttattaagaaaggagtagcaaaggttgatcatgtccagatgatagtattggatgaggcagataagttgctgtcacaggattttgtgcagataatggaggatattattctcacgctacctaaaaacaggcagattttactatattccgctactttccctcttagtgtacagaagttcatggtgagtataaatctgtacttggaatcagtgccatcctgtgacctttgagtatgcttttatttgtaattacatcttcatatctgtgaatatactttatgctaattatttcaagcctttggctctttcttcagttgatcaattaaagatttgttttacgtaaattaactgactttttaagaaggttgtaatagtaacttaattaaattcctcatctttcacttagtttttggtgtcatgatgacatagccattggtgctagctgaattgattccggtattattctatatacaaaacagagcttgagtatcctaaactgaaatccaaaatactgcagaatttgaaaccttttgagccacgaacatgatgctaaaaggaaatgttctttggattttgaattttcaaattaaggatgctcagtcactaagtgtaatgcacatattccaaaattagaaaaaatttaaaacctgaaacacttctgttcctaagcattttgggtaaggaatactcaacctgtagtaacttagctgcatttttgagatccttatatcttaatttatttctatcgggtcgggcatggtggctcatgcctgtaatcccagcactttggggggccgaggcgggcagatcacaaggtcaggagttcgagaccagcctgggcaacatggtgaaaccccgtctctactaaaaatacaaaaattagtctgttatggcagtgcatgcctgcattcccagctactcgggaggccgaggcaggagaatcacttgaacccgggaggtggaggttgcagggagcagagatcgtgccactacactccagcctgggtgacagagcaagattttgtctcagggtggcaggggggaaattctgtaatgacagatcatatattttgttttgaagagagttgcgtcccttacagcaagattttatcggacagaaacgtatagggtattgaagctcatggtgctagctncctgtgccgaat

SEQ ID NO: 72920 - DNA, 1189 bp, Homo sapiens
agcgggaggcggcgggcgggcgaacgggcgagcgagggagggggcagaggagccgagttagctcagccaggcggcgacttcggcggcgccacgagagcgggcagcggaggagattgacgtgagtgaattcagatataactcaagcttgttagagggctttttaaaaataaaaagttgattccgtgcaagagagcaagttactgctgcttaccgttcagagacttacaggtgcttgcctgcattgcaataaaggactcatttattgagcaagacttatatttatctcttcattttggagagcctaataaactgttattacagtttctctactgactttcaaaagttttgaagtttgaaagacctttgcaattaaaacagcatgagcacggccagaacagagaaccctgttataatgggtctgtccagtcaaaatggtcagctgagaggccctgtgaaacccactggtggccctggaggagggggcacacagacacagcaacagatgaaccagctgaaaaacaccaacacaatcaataatggcactcagcagcaagcacagagtatgaccaccactattaaacctggtgatgactggaaaaagactttaaaactccctccaaaggatctaagaatcaaaacttcggatgtgacctccacaaaaggaaatgagtttgaagattactgtttgaaacgggagttactgatgggaatttttgaaatgggctgggaaaagccatctcctattcaggaggagagcattcccattgctttatctggtagggatatcttagctagagcaaaaaatggaacaggcaagagcggtgcctacctcattcccttacttgaacggctagacctgaagaaggacaatatacaagcaatggtgattgttcccactagagaacttgctctacaggtcagtcaaatttgcatccaggtcagcaaacacatgggaggggccaaagtgatggcaaccacaggaggaaccaatttacgagatgacataatgaggcttgatgatacagtgcacgtggtgattgctacccctgggagaatcctggatcttattaagaaaggagtagcaaaggttgatcatgtccagatgatagtattggatgaggctagataagttgctgtcacaggattttgtgcaaatgggaattcatgacgtctgtacactaagacgggt

SEQ ID NO: 72921 - DNA, 575 bp, Homo sapiens
gagctcggtacccctcaacgctttatacttccttaattagctcatctatttggaacccaagcctcatattttctgtccagtcaatgttggttactaaatagaaaacctaattaaggaagtaacttttttccagggaggggtgggagagggaatttaaaaggtgtcaacttttgaccaaaaaaattgtgcccttgtaccgatgcagctctctttctcccccacctcttgcgagataagagggatcattcatgtagaagaaaagagtataaatgcaattctgtatctcgctagagaacgtgtgggtgactaaacaaaaagtgcagtctccttcaccaactttagactgcgtggtgccacatgcctgtgggtccctcttaaagcacagacttaaaatggaaagtattactgaagtatagcctctaatgaggagtggcacttaaactatctgggacaccactactggacacggtcttgtagaggcagctgtccagttttggtgcttgactcttgaataggaattgttaaatggaaagatgctctgagtgactaggtcaaagcctggtcttttttttttt

SEQ ID NO: 72922 - DNA, 516 bp, Homo sapiens
ctggaagtgtgaagttcaagtcaaaagctcacttaaatctataaggactctcggttgctattacaagtagaagaaaattaatgaattgtcttgtttaaattgtgtgatacttcagtgagttgtaatgcaattaagtataatgaatcactgacttttagagatgtcagagacttagagaattcatggggaggaaactgaagagaagagattatcattgacgagtagtgctaatttactagtctctttctacttaatctctggattgctttgaattaacaattttaaatgtttgatattggcctcattgtgtttttgagatagttcaaagttgtgtctatcctagcttggctcgtgatttggtctaagtgtagctgtattattaattctttaatataaaagatgagaattcttttaaagcggttcttttaaaagggaaacaaagtttttctgttgtgtttgctaatttaattttgtttgtttgtttcagattgacgtgagtgaattcagatataactc

SEQ ID NO: 72923 - DNA, 418 bp, Homo sapiens
agaggacagatgactttgttttatggccagtaggtatttgcaatagaataatatatttctgccataatttgttcagcaagtagtcatcctgaggtcagatgatacacacaaattttgtataaatggtttttggaaacatttctggctttcataattagtgtaaaagttattagcttagtttgttgtaaatgaataaaattattagtcatctcgtttttgtcagtatagtttttttacgactgcaccttaccctagttaaacagcagataaagccaactttatgtattaaatttaaagactcagtctgagtctttagagtctttaaagacttgcccagccttctgaactccaagcattattcactcagaaaattttctcgtaactttttttagcttatggaacttagcttttttacttt

SEQ ID NO: 72924 - DNA, 274 bp, Homo sapiens
gtcgtgctgatttacttggatctctgctattcatgtagaattcaaatgtaggatacttaggacacttaaagcaataccgaaagaggtatccttcagtgtatttcagagaggaatttgcttgtgtactacattcagaagtaattttgtattgtcttatctcttttaggaggagagcattcccattgctttatctggtagggatatcttagctagagcaaaaaatggaacaggcaagagcggtgcctacctcattcccttacttgaacggctagac

SEQ ID NO: 72925 - DNA, 490 bp, Homo sapiens
ttcacattgattttcatattttattcattaaaatttttaaacacatgttttttaggtcgctttggtcatcttggcttagccatcaacttgatcacatatgatgatcgcttcaacctgaaaagtattgaggagcagctgggaacagaaattaaacctattccgagcaacattgataagagcctgtatgtggcagaataccacagcgagcctgtagaagatgagaaaccttaacaagcatgtacgtccctgacagaacagctaagaggaacctttaaatgagggaaatcaaaatcttctttcctgggggaaatttgatgtcacaccatatataatagcaataaagggtaaaatacccactagcataaatgacagtaaataatatctcttgtgggaggttgtagtctcattcgagaatctgtaaatgttgttcttgaatgcagcttcccgggtaatgtggtagattagcagtacttaaattcagagtcctaaa

SEQ ID NO: 72926 - DNA, 251 bp, Homo sapiens
gatgaattaagagggaaatttataaagtaaaatctttagcgctgttgatcaaagagttccaggccgggcgtggtggctcatgcctgtaatcccagcactttgggaggctgaggtgggcagatcacgaggtcaggagatcaagaccatcctaacacggtgaaaccccatctctactaaaaatacaaaaaattagccgggcatggtggcgggcgcctgtagtagcagctacttgggaggctgaggcaggagaa

SEQ ID NO: 72927 - DNA, 348 bp, Homo sapiens
cggcacgaggagcatctgaaacagtacctggggctcaggaggattgcttaagcctaggagttcaagaccagcctggtcaacaaagcaagaccccatttctatagacagataaaatcaccatgcctggctaattttttaattattttgtagagatggggtctcactttgttgcacaggctgtttgcttgattcttaagaacgtatagggatccagctgtacagagctttctgcagtcttttgtaatagaattagttgttaaaattgtacttattacatgagcatcaaagaccttggaataaagctattcctcacatatctggacattatttggacttactatgttaccg

SEQ ID NO: 72928 - DNA, 367 bp, Homo sapiens
ttttaagatgggatctcacggttacccaggctggagtgcagtagtgcgtcatagctcactgtggcctgaaactcctgaactcaaactatcctcctgcctcagcctcccaaatagctgggactgcaggcacatgccaccatgcctggctaattttttaattattttgtagagatggggtctcactttgttgcacaggctgtttgcttgattcttaagaacgtatagggatccagctgtacagagctttctgcagtcttttgtaatagaattagttgttaaaattgtacttattacatgagcatcaaagaccttggaataaagctattcctcacatatctggacattatttggacttactatgttaccg

SEQ ID NO: 72929 - DNA, 304 bp, Homo sapiens
tctctaaatacaaaaattagccgggtgtggtgacgggcacatgtaatcccagcaactcaggaggcaggagaatcacttaaacctgagagaaggttgcagtgcgccgagattgcaccattgccctcaagccccggtgaaagtgcaagactccgactcaaaagaaaaagagagaggctttggctttgccttatctgtgctatctacctaacaccggtaattttggaatctggaagatttttcatttagaagctctttctattctggtcctggctggatatatacattacagattatttctaaggta

SEQ ID NO: 72930 - DNA, 717 bp, Homo sapiens
atttaatacgtttcacatcctagaaagattatgtcagtggtgtgtagggtggattggagatggagaaagcagaattcctttcaataacttcattatactgaacacatttattgagagtgatcatatttacagattcatggaatcagacaactggcggggctgcgatgctttcttagttttcctcattcattttcaaatagaatacctgaggtttactcaggatcacagaagtggttctgtgatagcttagtctagaattcagtcttcagcatgtactaggtgattaataaaggtgaattcacctctctcttctctcccaagtcccatttcagtgtttgtgtcattctgccacattgcattgtactagcagatagaaggacttaacatcattccattctaccgtctttttttaaccagtccaaagtgaatagaggtattttcctaggtctgactgagaaagatgttccctgagagtaccattgggaagaggggcagttcggtgccctggactgggctgaatgaggtgttaggatttttcagctgtagtgattcagatgtagaagaatgtcaaggtatttgttttgttgcatgtctttatctctgccactaagctccctttaagttgttttcttttaaacttagttttatttgtgccactgaaacttgttaaataagctatgataaattgggcactgattaaaagtatatttatctaaa

SEQ ID NO: 72931 - DNA, 1261 bp, Homo sapiens
tcatttattttataaaagcatctccttctataactcaaaattttctttaagtgtcatataaaagtgtacattttacttttaagcaactaatttagatacctaagaaaaactatgtgcattaggaaaagtcatgtttttcttctcagaaaggttgatcacatgacatgtctactaagaattttcacctctgtacttgtatgtatattttattgttactcaatcttgtattttatttacaaattcaacactgtcaaccctgggaattctaaaataccaatgtatttttaggttgtagctaatgttgtattcactttcaattctcagttgtccacactggtgatataagaggaacaaatcagaatcattaaatactttgtaatgccatcataaactcatatattcatcctcaaactcccttgtttaatgctaattggtggcctggaacttcactgagatgcaaaatcaagaactgaagcctagttgctagataacaaaaagctataaatgtttatgtatgtgaattttaaattagaataaccgtcttaaactcctacttgccatttctaaggcaaagcattcattttaatattgtactttgccttttcattcagttagtggagtaagtcatgaaacccttaggaagaaaaacaagttatgacttattcactaaaattgatgcaagacagttggttctagatgaccatggccatgtgttcatcatataaaaccttcagttctctctatggtgcttggctggagattgacatgtgaggatgtgccaatcatattaaatggatttggtctatgtgggtgatatgtggcctgaatgtaactgtgatagactgaaatttgttcttagctctcaaaatccactgaagaagtcaagtgaaggtgggtaaaatagggagattagtgacaactttgtgccaaattttttaaaaaatggaagcaggtagccaatattagaatgataatttaagggtgtggttgaattttagttagttgtcacatagttattgaacctcatatgctcagtgctgtgggaatcaaacatggaagaggtatggctcctgcccctaatgagaacaagggggaaaaatccagatataatctaaatgctaggttatgtcagggtataggaacacagagaatgggggacctgtaagaactggaagagtcagagagggctccattgaagaggtcaaacataattccggaaagaataggtagtgaggagattgtgccaggaaaataagtggga

SEQ ID NO: 72932 - DNA, 1406 bp, Homo sapiens
tgcctcgcggggttgcggcgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggtcgcgctcgccaggccgcggagcccagagctgcgcgcacgaaccgtgcgccgggagggcgtgggcgtggcgccgaagggtcccgggtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacagggaactcagaaacaaagcaaatattcaatttggagataatggaacaacaatatctgctgttagcaacaaggcctatgtttttgaacgagaccaatctgttggagaccctaaaattgacttaattagaacattaaatattcctgtattgactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgaggtaagtagatttttcttttcagaacctctttttttagctgacagtgggttggggcaccccaagccagattaactttgagtttcttctagaaattgcctagagttaagttatcttatagagtgtgtgaaaaatggagtgttttttggaaagaaaaaaaacttgaggccgggtgcggtggctaatgcctgtaattccaggactttgggagaccgaggtgggtggatcacttgaggttaagactttgagaccagcctggccaacatggcaaaactctatctctactaaaaatacaaaaattagccagctgtggtgatgtacacctgtaatctcacctactcaggagactgaggcaggtaagttgcatgaacccaggaggcagaggttgcagtgagctgaagttacaccactgtactccagccagggtgacagagcaagactctgtctaaaaaagcc

SEQ ID NO: 72933 - DNA, 2752 bp, Homo sapiens
  misc_feature (817)..(817): n is a, c, g, or t
  misc_feature (1018)..(1018): n is a, c, g, or t
  misc_feature (1033)..(1033): n is a, c, g, or t
  misc_feature (1336)..(1336): n is a, c, g, or t
  misc_feature (1392)..(1392): n is a, c, g, or t
  misc_feature (1464)..(1464): n is a, c, g, or t
  misc_feature (2066)..(2066): n is a, c, g, or t
  misc_feature (2354)..(2354): n is a, c, g, or t
aaaatacttagcccagggcccatcacacagtaaccaatattaagtgttggctcttagttactatgatatgctctgtcaagcatcaactgacctggtctacttccagtcaataggtagtctctacatggaagccaaataaaagatactgttgtccatatttcagcagagtggtttcctcaggggaggcagagaaggaatggaatcaagagcattacgtagacaggttcagttatatccataatataatttttatttgtctaagtggcagatacaaaggtatttgttagagtattttatctctttctggtgcctaaaatttttcattaaaaaatgctgtaggggtggtttggtttgtgcagtgaaaccacctatgttattcacaaccttgcgagagatgtatcaacagctctggttcagagatgaaaaagtgaggcccagaaggctcttccggccagccttcaaaggaagggctgaaggctcagtggtgactgtgtacatcaaagtggttaggcactatgcagtgtaagcagtggtcatattacatgggactatgtttgaaatcagtaagaatgaaaggcagaataacgttgaactccatttaaataaatgactggggcaaaatatggaatctgatttttcttggagggggggattgagtatcaaagtgtgtattccaataaagtatctgtccaatgtgacacttttcaagtgcctaagaccctacgaggccacggccatcgctgcctgttctaccttagctttggctctgccgtgccctggcttccctggctttgccggtggcccgtccacactggcntatgtccatgcaggtctagagaggcctcttatttcttttttatgtgagtctccattctaaatgttatcatcttaattttgtaccacatattgttttttcttgtttggatgatatcaccgttgctacaataaacaccttccactacaattcatcttctgctttattacacgttgagttgacagaatgccttccaaacattcntttctacttaccctntgagcttttggccatgttgtacctgagaactgttgctaacttgcggatttcgggcagattacactgaccagagtccacattcactttttattcttacatcctaacaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtaagaactcagagaggggacatganaggggtgtcaagaatgcagaaggattggagttcaacaaagaatatgtagctgggcntagtggcgcacacctacagtcccagctactaaggatgctgaggtgggatgatcacttgagcccaggagttcncaagtccatcctgggcaacatggcgagaccactgtctctaaaaaacaaaacaaacaaaaaagaatatattgtcagcccaatagaaagatcagtttctttcaagaacaatgtttcataacatggctattgaatggtaaaaaaaaatcatggcttttctgtgatgctttttatttctagaatgccatgttgtgtttttttttctggacagtggtttagaagtcttaacagtaataatagctcatgtttactaagcacctgatgtatgccagtcactgtcctaagtgctttacatatttacatgtagttaatgcctgcaaaacattaactgatttcatgttcaaaacaatgctaaggctgggcacggtggctcatgcttgtattcccagcactttgagaggccgagatgtgaggattgcttgaggccaggggttcaagatcagcctgggcaacatagcaagaccctgtctctacaaaaaaaaaaaaattaaaaaattagctgggtgtggcggcacacacctgtagttacagctgctcaggaggctgaggcagagagattgcttgaacccaggagttcgaggttgcactgtgctatgattgtgctnctgcactccagcctgggcaatagagtgattccgcacctccccaccaaaaaaaaaaagctaaaagaaaaagtggacaactcagttttaagaaagtacgtatcatggcaaagattctcagtgattttgaagcagagttagttttaaaccctgacacaaatgtcccagtgtttcttaatgtcagagctactctgctcctttccatgaatgaggcagaattatcagtggcacaactgacaaaactattttcttcatcttgaagagtagttttaacagccacatgttgcaganttattcacaatgaacttactagatagtagacattcagcggcctgtttttataattggggaaactagggctcagagagggaacgtgattttgatgcgactcctccctctgagcagatccctggcggaactcagggtcttctcatatttgccctgtgattccctcttgggctgtaattcctctttaaaatttctctggagagctctctgtgtagtccctttctcctgaatagtaatgtgctcacttttgctcccttatctatctcattttaaaatctcctttcaggcctggcatggtggcgtgtgcctgtagacccagctactcaggaggctatggtggaagggtcgtttgagcccagtttgattctagcctgggcaacatagcgagactccatctttta

SEQ ID NO: 72934 - DNA, 248 bp, Homo sapiens
tggagggggcccagccactcattattgagggtaacctcccttaaagttaacggattgtagatattaatcacacctacaaaataccttcaccacaccatctgggctagtgtttgaccaaacaactgggcaccatagtctagccaagttgtcataaaattatcacagttactttaaatgatcatattcacatattttcagaaaaatgggtcgacgcggccgcgaatttagtagtagtagtaggcggccgc

SEQ ID NO: 72935 - DNA, 4753 bp, Homo sapiens
tgcctcgcggggttgcggcgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggtcgcgctcgccaggccgcggagcccagagctgcgcgcacgaaccgtgcgccgggagggcgtgggcgtggcgccgaagggtcccgggtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacagggaactcagaaacaaagcaaatattcaatttggagataatggaacaacaatatctgctgttagcaacaaggcctatgtttttgaacgagaccaatctgttggagaccctaaaattgacttaattagaacattaaatattcctgtattgactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgagaaaaatgggactaatgatggagactatgtttttctaactggagaagacagttaccttaactttacaaaaattgtggaatggaatgggaaaacgtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccttcttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattctttttttttgagagagtctcactctgtcgccaggctggagtacagtggcatgatctcggctcactgcaacctctgcctcccgggttcaagcaattctcctgcctcagccacccaagtagctgggactacaggtgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttatataaaa

SEQ ID NO: 72936 - DNA, 4925 bp, Homo sapiens
tgcctcgcggggttgcggcgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggtcgcgctcgccaggccgcggagcccagagctgcgcgcacgaaccgtgcgccgggagggcgtgggcgtggcgccgaagggtcccgggtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacagggaactcagaaacaaagcaaatattcaatttggagataatggaacaacaatatctgctgttagcaacaaggcctatgtttttgaacgagaccaatctgttggagaccctaaaattgacttaattagaacattaaatattcctgtattgactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgagaaaaatgggactaatgatggagactatgtttttctaactggagaagacagttaccttaactttacaaaaattgtggaatggaatgggaaaacgtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccttcttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattctttttttttgagagagtctcactctgtcgccaggctggagtacagtggcatgatctcggctcactgcaacctctgcctcccgggttcaagcaattctcctgcctcagccacccaagtagctgggactacaggtgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttatataaaaaaaaaaaggggcggcaaagtacctcaaggccagttaagcgtacccgtttggaaagggcctaaggggggattaaacagccgccgcgtaaacgcgcgggacaggctcgcatttggagacctcgggggcatgcccccggtgcgaaatgtgagacccttggaagcggtaacaaaga

SEQ ID NO: 72937 - DNA, 5239 bp, Homo sapiens
  misc_feature (5100)..(5100): n is a, c, g, or t
  misc_feature (5142)..(5142): n is a, c, g, or t
tgcctcgcggggttgcggcgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggtcgcgctcgccaggccgcggagcccagagctgcgcgcacgaaccgtgcgccgggagggcgtgggcgtggcgccgaagggtcccgggtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacagggaactcagaaacaaagcaaatattcaatttggagataatggaacaacaatatctgctgttagcaacaaggcctatgtttttgaacgagaccaatctgttggagaccctaaaattgacttaattagaacattaaatattcctgtattgactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgagaaaaatgggactaatgatggagactatgtttttctaactggagaagacagttaccttaactttacaaaaattgtggaatggaatgggaaaacgtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccttcttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattctttttttttgagagagtctcactctgtcgccaggctggagtacagtggcatgatctcggctcactgcaacctctgcctcccgggttcaagcaattctcctgcctcagccacccaagtagctgggactacaggtgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttatataaaaagacaacaggtgtgaaacgccacccacttcattgaatctttctctcataaatcaaaatctttattggaaggagtcagcaaattctctcaccttcatcacttccgggagaggagtaggagcaacatctatttacttctggcaggaggtaacgacacttcttcccatccctaggaactaggtaaaggcccactgatccttagaaagagttagacacgctgcctgtctggtcataggagggagtacaaatccttctgggttcaggacctcataccagtaataaggaagtgtccgctctttctgcaggaggggaaggctctcttctttggaatatctgccatagatatgangaagtttgactgctttgggagagcaggagtcagaatactcantaagctctacacacaggttccaatcatatagatcctacctgaggctgatgctgtaccagtagaacccaagagatccccataggtccccatgacgctt

SEQ ID NO: 72938 - DNA, 4707 bp, Homo sapiens
tgcctcgcggggttgcggcgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggtcgcgctcgccaggccgcggagcccagagctgcgcgcacgaaccgtgcgccgggagggcgtgggcgtggcgccgaagggtcccgggtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacagggaactcagaaacaaagcaaatattcaatttggagataatggaacaacaatatctgctgttagcaacaaggcctatgtttttgaacgagaccaatctgttggactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgagaaaaatgggactaatgatggagactatgtttttctaactggagaagacagttaccttaactttacaaaaattgtggaatggaatgggaaaacgtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccttcttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattctttttttttgagagagtctcactctgtcgccaggctggagtacagtggcatgatctcggctcactgcaacctctgcctcccgggttcaagcaattctcctgcctcagccacccaagtagctgggactacaggtgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttatataaaa

SEQ ID NO: 72939 - DNA, 3870 bp, Homo sapiens
tgcctcgcggggttgcggcgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggtcgcgctcgccaggccgcggagcccagagctgcgcgcacgaaccgtgcgccgggagggcgtgggcgtggcgccgaagggtcccgggtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacagggaactcagaaacaaagcaaatattcaatttggagataatggaacaacaatatctgctgttagcaacaaggcctatgtttttgaacgagaccaatctgttggagaccctaaaattgacttaattagaacattaaatattcctgtattgactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgagaaaaatgggactaatgatggagactatgtttttctaactggagaagacagttaccttaactttacaaaaattgtggaatggaatgggaaaacgtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccttcttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattctttttttttgagagagtctcactctgtcgccaggctggagtacagtgagctgagatcgtgccattctactccagcctgggtgacagtgcgagactctgtctcaaaaaa

SEQ ID NO: 72940 - DNA, 3882 bp, Homo sapiens
  misc_feature (55)..(55): n is a, c, g, or t
agaaatatttatttatgacaattgcgaaaaaaaagaaaaaggtttaaggagaacngactctcttcttgaaccggcgaaacagaaaaatgggactaatgatggagactatgtttttctaactggagaagacagttaccttaactttacaaaaattgtggaatggaatgggaaaacgtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccttcttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattctttttttttgagagagtctcactctgtcgccaggctggagtacagtggcatgatctcggctcactgcaacctctgcctcccgggttcaagcaattctcctgcctcagccacccaagtagctgggactacaggtgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttatataaaa

SEQ ID NO: 72941 - DNA, 2867 bp, Homo sapiens
tgcctcgcggggttgcggcgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggtcgcgctcgccaggccgcggagcccagagctgcgcgcacgaaccgtgcgccgggagggcgtgggcgtggcgccgaagggtcccgggtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacagggaactcagaaacaaagcaaatattcaatttggagataatggaacaacaatatctgctgttagcaacaaggcctatgtttttgaacgagaccaatctgttggagaccctaaaattgacttaattagaacattaaatattcctgtattgactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgagaaaaatgggactaatgatggagactatgtttttctaactggagaagacagttaccttaactttacaaaaattgtggaatggaatgggaaaacgtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaatcacttctctcagggaaaattaggagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttatataaaa

SEQ ID NO: 72942 - DNA, 4728 bp, Homo sapiens
  misc_feature (817)..(817): n is a, c, g, or t
  misc_feature (1018)..(1018): n is a, c, g, or t
  misc_feature (1033)..(1033): n is a, c, g, or t
aaaatacttagcccagggcccatcacacagtaaccaatattaagtgttggctcttagttactatgatatgctctgtcaagcatcaactgacctggtctacttccagtcaataggtagtctctacatggaagccaaataaaagatactgttgtccatatttcagcagagtggtttcctcaggggaggcagagaaggaatggaatcaagagcattacgtagacaggttcagttatatccataatataatttttatttgtctaagtggcagatacaaaggtatttgttagagtattttatctctttctggtgcctaaaatttttcattaaaaaatgctgtaggggtggtttggtttgtgcagtgaaaccacctatgttattcacaaccttgcgagagatgtatcaacagctctggttcagagatgaaaaagtgaggcccagaaggctcttccggccagccttcaaaggaagggctgaaggctcagtggtgactgtgtacatcaaagtggttaggcactatgcagtgtaagcagtggtcatattacatgggactatgtttgaaatcagtaagaatgaaaggcagaataacgttgaactccatttaaataaatgactggggcaaaatatggaatctgatttttcttggagggggggattgagtatcaaagtgtgtattccaataaagtatctgtccaatgtgacacttttcaagtgcctaagaccctacgaggccacggccatcgctgcctgttctaccttagctttggctctgccgtgccctggcttccctggctttgccggtggcccgtccacactggcntatgtccatgcaggtctagagaggcctcttatttcttttttatgtgagtctccattctaaatgttatcatcttaattttgtaccacatattgttttttcttgtttggatgatatcaccgttgctacaataaacaccttccactacaattcatcttctgctttattacacgttgagttgacagaatgccttccaaacattcntttctacttaccctntgagcttttggccatgttgtacctgagaactgttgctaacttgcggatttcgggcagattacactgaccagagtccacattcactttttattcttacatcctaacaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccttcttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattctttttttttgagagagtctcactctgtcgccaggctggagtacagtggcatgatctcggctcactgcaacctctgcctcccgggttcaagcaattctcctgcctcagccacccaagtagctgggactacaggtgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttatataaaa

SEQ ID NO: 72943 - DNA, 2039 bp, Homo sapiens
tgcctcgcggggttgcggcgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggtcgcgctcgccaggccgcggagcccagagctgcgcgcacgaaccgtgcgccgggagggcgtgggcgtggcgccgaagggtcccgggtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacagggaactcagaaacaaagcaaatattcaatttggagataatggaacaacaatatctgctgttagcaacaaggcctatgtttttgaacgagaccaatctgttggagaccctaaaattgacttaattagaacattaaatattcctgtattgactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgagaaaaatgggactaatgatggagactatgtttttctaactggagaagacagttaccttaactttacaaaaattgtggaatggaatgggaaaacgtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaa

SEQ ID NO: 72944 - DNA, 2177 bp, Homo sapiens
tgcctcgcggggttgcggcgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggtcgcgctcgccaggccgcggagcccagagctgcgcgcacgaaccgtgcgccgggagggcgtgggcgtggcgccgaagggtcccgggtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacagggaactcagaaacaaagcaaatattcaatttggagataatggaacaacaatatctgctgttagcaacaaggcctatgtttttgaacgagaccaatctgttggagaccctaaaattgacttaattagaacattaaatattcctgtattgactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgagaaaaatgggactaatgatggagactatgtttttctaactggagaagacagttaccttaactttacaaaaattgtggaatggaatgggaaaacgtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatga

SEQ ID NO: 72945 - DNA, 812 bp, Homo sapiens
tgcgattgcacaacctccgctcactgcagcctcgacctcacagactgaagcaatcccccgtcgaccggtcgacctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttatataaaa

SEQ ID NO: 72946 - DNA, 2777 bp, Homo sapiens
  misc_feature (1361)..(1361): n is a, c, g, or t
  misc_feature (1417)..(1417): n is a, c, g, or t
  misc_feature (1489)..(1489): n is a, c, g, or t
  misc_feature (2091)..(2091): n is a, c, g, or t
  misc_feature (2379)..(2379): n is a, c, g, or t
tgcctcgcggggttgcggcgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggtcgcgctcgccaggccgcggagcccagagctgcgcgcacgaaccgtgcgccgggagggcgtgggcgtggcgccgaagggtcccgggtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacagggaactcagaaacaaagcaaatattcaatttggagataatggaacaacaatatctgctgttagcaacaaggcctatgtttttgaacgagaccaatctgttggagaccctaaaattgacttaattagaacattaaatattcctgtattgactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgagaaaaatgggactaatgatggagactatgtttttctaactggagaagacagttaccttaactttacaaaaattgtggaatggaatgggaaaacgtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtaagaactcagagaggggacatganaggggtgtcaagaatgcagaaggattggagttcaacaaagaatatgtagctgggcntagtggcgcacacctacagtcccagctactaaggatgctgaggtgggatgatcacttgagcccaggagttcncaagtccatcctgggcaacatggcgagaccactgtctctaaaaaacaaaacaaacaaaaaagaatatattgtcagcccaatagaaagatcagtttctttcaagaacaatgtttcataacatggctattgaatggtaaaaaaaaatcatggcttttctgtgatgctttttatttctagaatgccatgttgtgtttttttttctggacagtggtttagaagtcttaacagtaataatagctcatgtttactaagcacctgatgtatgccagtcactgtcctaagtgctttacatatttacatgtagttaatgcctgcaaaacattaactgatttcatgttcaaaacaatgctaaggctgggcacggtggctcatgcttgtattcccagcactttgagaggccgagatgtgaggattgcttgaggccaggggttcaagatcagcctgggcaacatagcaagaccctgtctctacaaaaaaaaaaaaattaaaaaattagctgggtgtggcggcacacacctgtagttacagctgctcaggaggctgaggcagagagattgcttgaacccaggagttcgaggttgcactgtgctatgattgtgctnctgcactccagcctgggcaatagagtgattccgcacctccccaccaaaaaaaaaaagctaaaagaaaaagtggacaactcagttttaagaaagtacgtatcatggcaaagattctcagtgattttgaagcagagttagttttaaaccctgacacaaatgtcccagtgtttcttaatgtcagagctactctgctcctttccatgaatgaggcagaattatcagtggcacaactgacaaaactattttcttcatcttgaagagtagttttaacagccacatgttgcaganttattcacaatgaacttactagatagtagacattcagcggcctgtttttataattggggaaactagggctcagagagggaacgtgattttgatgcgactcctccctctgagcagatccctggcggaactcagggtcttctcatatttgccctgtgattccctcttgggctgtaattcctctttaaaatttctctggagagctctctgtgtagtccctttctcctgaatagtaatgtgctcacttttgctcccttatctatctcattttaaaatctcctttcaggcctggcatggtggcgtgtgcctgtagacccagctactcaggaggctatggtggaagggtcgtttgagcccagtttgattctagcctgggcaacatagcgagactccatctttta

SEQ ID NO: 72947 - DNA, 503 bp, Homo sapiens
tactactaaattcgcggccgctcgaccagaatgcaagcttctggtaccatgatcctcaacttagagaggaagaaaccaagacagagagcttaactcacttctctcagggaaaattaggagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttatataaaa

SEQ ID NO: 72948 - DNA, 403 bp, Homo sapiens
aggtctctcctccttccatgcccccactccccacccaaacttttcacactggggagaagtttctgacatgaacatctaacttgttttctctcttctgtgtttcagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagt

SEQ ID NO: 72949 - DNA, 401 bp, Homo sapiens
ccaggaacttttatattcagcttagattttaaaaacagcatcattcatttctgttttccttcaaatgcaggtgcacccatcattatgtctttcccacacttttaccaagcagatgagaggtttgtttctgccatagaaggcatgcacccaaatcaggaagaccatgagacatttgtggacattaatcctgtgagtacatactacctcctggtaaaagagcatatgttttattctgtctatacattgttcaccagtttagtcctgagccttctttaaaaatatccttactttcatatacatattcaagtgggagaaattcagctcagtgctgatggaggcattgtctcatagccctgtaattagaaggctgaattttgtggattgaatagcagaaatacgag

SEQ ID NO: 72950 - DNA, 748 bp, Homo sapiens
aagaaacctctgtttttgcttgtaaggctttgaacagattggagggggcccagccactcattattgagggtaacctcccttaaagttaacggattgtagatattaatcacacctacaaaataccttcaccacaccatctgggctagtgtttgaccaaacaactgggcaccatagtctagccaagttgtcataaaattatcacagttactttaaatgatcatattcacatattttcagaaaaatgggactaatgatggagactatgtttttctaactggagaagacagttaccttaactttacaaaaattgtggaatggaatgggaaaacgtaagtcaaatgatttatcagtggaattattttttcagttttcatttaaactacatgtctacttctacattgcttaaaaatgtgtttagccttttttggatgaaaaatataaaaacatgtaaatagtcttgtaattattattctacaaatcaagatggtggtaaaacatcttacagattaaatattagtgatttgtagatttatcatggccaggcatgaattacaggccagtgaaaagtcccactcttgcttaatagtcattgagtgatgtgtagtagctacagcacaaatacttttcaaaccaccacatgttttgggctatttggccattgcctctatgaaagctgatttgggccagggacctactttttctcccccttgatctaattaaaactgttgtgtctgtgtatgaataagat

SEQ ID NO: 72951 - DNA, 1381 bp, Homo sapiens
tgcctcgcggggttgcggcgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggtcgcgctcgccaggccgcggagcccagagctgcgcgcacgaaccgtgcgccgggagggcgtgggcgtggcgccgaagggtcccgggtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacagggaactcagaaacaaagcaaatattcaatttggagataatggaacaacaatatctgctgttagcaacaaggcctatgtttttgaacgagaccaatctgttggatcaccctatagaagaactaatgtagtcactaagtaacatgacaaacataactcctccggataagcctgcgtccgactcaaaacactgaactgagcaatgcaaacagcgcaatatctacaaatcaagacaacaagtccattattaccctcacgtgtcaacccgaacaacaagaaatgctcactcaggacaaggtctccaacacaagtacaagggaacctcgcggaaactccttacgcccggcatggattaccaaaaaacaatcaccttcctagacattcaaaccaagtattcacgagggacaccgcgttggcaccaatgaaacaccatgcttaaacaggccagcgagtacccctcacccgatgcaaacaaggtaaacataaatcaattatgtgtacccgttgacacagtcagagggcaaccagtggtaactcgaaagtgcagacatacacaacagacaggagattaccaaaacacggatcatcgataacacaatcacagaccaaggtgtcacacaattgtcaccctggcgcacgactgaaaaacacagagacgcaagaaatataagacaacagtgcaacgaacagctcacaagacaccgtcatcggacgagatctcgaactgacatatacaagcacaaaaagatgaaccataacaaaaagcaa

SEQ ID NO: 72952 - DNA, 4698 bp, Homo sapiens
tgcctcgcggggttgcggcgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggtcgcgctcgccaggccgcggagcccagagctgcgcgcacgaaccgtgcgccgggagggcgtgggcgtggcgccgaagggtcccgggtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacagggaactcagaaacaaagcaaatattcaatttggagataatggaacaacaatatctgctgttagcaacaaggcctatgtttttgaacgagaccaatctgttggagaccctaaaattgacttaattagaacattaaatattcctgtattgactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgagaaaaatgggactaatgatggagactatgtttttctaactggagaagacagttaccttaactttacaaaaattgtggaatggaatgggaaaacgtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgattttcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccttcttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattctttttttttgagagagtctcactctgtcgccaggctggagtacagtggcatgatctcggctcactgcaacctctgcctcccgggttcaagcaattctcctgcctcagccacccaagtagctgggactacaggtgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttatataaaa

SEQ ID NO: 72953 - DNA, 4512 bp, Homo sapiens
tgcctcgcggggttgcggcgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggtcgcgctcgccaggccgcggagcccagagctgcgcgcacgaaccgtgcgccgggagggcgtgggcgtggcgccgaagggtcccgggtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacagggaactcagaaacaaagcaaatattcaatttggagataatggaacaacaatatctgctgttagcaacaaggcctatgtttttgaacgagaccaatctgttggagaccctaaaattgacttaattagaacattaaatattcctgtattgactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgagaaaaatgggactaatgatggagactatgtttttctaactggagaagacagttaccttaactttacaaaaattgtggaatggaatgggaaaacgtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccttcttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattctttttttttgagagagtctcactctgtcgccaggctggagtacagtggcatgatctcggctcactgcaacctctgcctcccgggttcaagcaattctcctgcctcagccacccaagtagctgggactacaggtgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccacttttagctccaggcttttctaaccagacttgatttcctcatgttctagaaagatcactaatggtcaagtggaaccaacaaccctggtaccggctcgattcctgcctttct

SEQ ID NO: 72954 - DNA, 4438 bp, Homo sapiens
tcacccagtacaattctgtcttaccattcaaattgtctgcaagcctgaatttttgtggccatgggacaaagaatgccatctttagcttcacaaaggaaaagtcctgcaacatttttgacccccaacatggggctcaagaagcgaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacagggaactcagaaacaaagcaaatattcaatttggagataatggaacaacaatatctgctgttagcaacaaggcctatgtttttgaacgagaccaatctgttggagaccctaaaattgacttaattagaacattaaatattcctgtattgactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgagaaaaatgggactaatgatggagactatgtttttctaactggagaagacagttaccttaactttacaaaaattgtggaatggaatgggaaaacgtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccttcttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattctttttttttgagagagtctcactctgtcgccaggctggagtacagtggcatgatctcggctcactgcaacctctgcctcccgggttcaagcaattctcctgcctcagccacccaagtagctgggactacaggtgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttatataaaa

SEQ ID NO: 72955 - DNA, 3870 bp, Homo sapiens
gttaacaattgacaatataaggaaaagaaagacctatctgcaacaactctcttattttccaccgctacacaaaaatgggactaatgatggagactatgtttttctaactggagaagacagttaccttaactttacaaaaattgtggaatggaatgggaaaacgtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccttcttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattctttttttttgagagagtctcactctgtcgccaggctggagtacagtggcatgatctcggctcactgcaacctctgcctcccgggttcaagcaattctcctgcctcagccacccaagtagctgggactacaggtgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttatataaaa

SEQ ID NO: 72956 - DNA, 3436 bp, Homo sapiens
gatctcctagaggtatcccacacgacgcctactggtttgccatacactgtgctgggctcgagtcatctttgttgggaagatgactggtaacccagcacagtgtattagaccatgatacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccttcttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattctttttttttgagagagtctcactctgtcgccaggctggagtacagtggcatgatctcggctcactgcaacctctgcctcccgggttcaagcaattctcctgcctcagccacccaagtagctgggactacaggtgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttatataaaa

SEQ ID NO: 72957 - DNA, 2335 bp, Homo sapiens
  misc_feature (2080)..(2080): n is a, c, g, or t
  misc_feature (2087)..(2087): n is a, c, g, or t
  misc_feature (2089)..(2089): n is a, c, g, or t
  misc_feature (2100)..(2100): n is a, c, g, or t
tgcctcgcggggttgcggcgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggtcgcgctcgccaggccgcggagcccagagctgcgcgcacgaaccgtgcgccgggagggcgtgggcgtggcgccgaagggtcccgggtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacagggaactcagaaacaaagcaaatattcaatttggagataatggaacaacaatatctgctgttagcaacaaggcctatgtttttgaacgagaccaatctgttggagaccctaaaattgacttaattagaacattaaatattcctgtattgactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgagaaaaatgggactaatgatggagactatgtttttctaactggagaagacagttaccttaactttacaaaaattgtggaatggaatgggaaaacgtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaaaaaaaaaaaaaaagaaaaaaaaagaaaaaaaaaaaaaaaanaaacaangnagaaaaaacanaacaagagagcacacagcacgcagcacgggggcacgagagacggcgcgagagagagaaagacaaaaggcaaaagcggaggcggggagcggggaccccgtaggaataaaaaacgaacgcgggggaagaagagcgcacccacagagaccaccggccggaaagaagagaaaggggagggggcacaccagcgaaaaagagcgggcgcggagaggccaaggagtggagcagaaaaaccgg

SEQ ID NO: 72958 - DNA, 1856 bp, Homo sapiens
  misc_feature (77)..(77): n is a, c, g, or t
acgcccgggcagccacggcggcggggccgcggcgggcgccggctcagcccgcccctttctcccgccgcctccccgcnccgccccgcgccgcgccggccgctgtcagctccctcagcgtccggccgaggcgcggtgtatgctgagccgctgccgcagccggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgagaaatatggctacacacacctttctgcaggagagctgcttcgtgatgaaaggaagaacccagattcacagtatggtgaacttattgaaaagtacattaaagaaggaaagattgtaccagttgagataaccatcagtttattaaagagggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaagcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctatttttttttaaattcaaaaagaatatcccttttatagtttgtgccttctgtgagcaaaactttttagtacgcgtatatatccctctagtaatcacaacattttaggatttagggatacccgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatg

SEQ ID NO: 72959 - DNA, 1938 bp, Homo sapiens
atatgatggatgagaaatgcagaccagccccacatcatggtgttaccatttctcagcagataataggcacagtattttccagattccagatgtgctgaggcagaacaaggagtacacagatacagacagaaacccatcccaaaccacaaatggacaaaaatctacaaggcaatggaagcaggagactcttttcgcctaagttagatggatttctttagctgaagctttttgagaagatagaatgtttctgtcttataaattccttgatgatgccaagaaactcagacatcataaaggattttcgctttccagaattttcagtaagaatgacagatgtttctcagataattttcaggcatcaccacttcttctgttgtgattgttattctctggctcctctttacttgattgcaaatttaaaagaacactggcattttagaaatatgtaagctttgtatttgagcctttgcaagtaaagaataaaaagagaatagtttacaattcagcccacagaatacgttagaacactatagaatgctgagtttaggagaaggttcactccatattaatcttttattgtacacgattatggttagaaaacgatttgagctatgttcaacatcagccatctgtatatttgacataatgaacatgagtcacagagtttcaattttaattacagtttttgttttgtgaagctttaatatatgtttgcagtgctgtgcatgttggttgggaagcattttgtaacttgaaaaggagaaaggaacttggaattcaggtttctcaaattaccaaaatccttctgaggaaaaattgtattatgttggcatgtgctttttttttttcgattggcagtgttgatggaagtctcatctatgttatcttcagaacacatttagagactcctacacctctgaaaacttgagagtcagtactgtttggttaatttatacattaatcaggtgtgtatcaattatcagcaatgtgcaaagctccatgtatgccactcccggtattgcaaaaaattataatccacatttcctgcccttttccagttatataacaatatctgagggatgccaaaaatcttgtgtggggtaaatttccagttgaatggtataaaattacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgcta

SEQ ID NO: 72960 - DNA, 985 bp, Homo sapiens
  misc_feature (77)..(77): n is a, c, g, or t
acgcccgggcagccacggcggcggggccgcggcgggcgccggctcagcccgcccctttctcccgccgcctccccgcnccgccccgcgccgcgccggccgctgtcagctccctcagcgtccggccgaggcgcggtgtatgctgagccgctgccgcagccggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgagaaatatggctacacacacctttctgcaggagagctgcttcgtgatgaaaggaagaacccagattcacagtatggtgaacttattgaaaagtacattaaagaaggaaagattgtaccagttgagataaccatcagtttattaaagagggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgaggtaatgaaaatcttcatctgcccacataggctttaagcaactgttagtcaactattagaaaaaacaaaggattttttaacttatattttatattggcagcagtgttttttgaattggtagattggatggacggaacagcactgtcttgctgttggagtattaaaaactatttggcattagcagccttgtggagctaaattttcctttattttcaaaataacaagaatcagttttgatttttaaaaaataagaattgacatacataataatattaggtaatgaagctgaactactttcttaggtagacattattatcaaagagtattttgccttagggtgttgtttactggaagagaaacacgtttctgagaagttggg

SEQ ID NO: 72961 - DNA, 553 bp, Homo sapiens
  misc_feature (553)..(553): n is a, c, g, or t
agcagtggtatcaacgcagagtgcccattacggcgggagattaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgaaaaaaaaaaaacaaaaaaaaaaaaaaaaattgtgtgtggggcggccggggcccggaaaaagtttttaaaccctttcgttgggggcgcgcgggcggggccccagtaggtgtaatggtggcactatgggcgtcatacagcgtggttcccaagaggaagaaatcgctcgggcctagcgaactagtgtgggtgtggggtttctccacccaatataaaaaaaaaagcgccggcggggaaacaaccgcggggttttctggaaaccaaattccagagatagggaggtccggaaaggcacatagggtttcttaccacgcgcgggtcccagagggagcggatataaatcagcgcaggggggggan

SEQ ID NO: 72962 - DNA, 3274 bp, Homo sapiens
  misc_feature (77)..(77): n is a, c, g, or t
  misc_feature (3274)..(3274): n is a, c, g, or t
acgcccgggcagccacggcggcggggccgcggcgggcgccggctcagcccgcccctttctcccgccgcctccccgcnccgccccgcgccgcgccggccgctgtcagctccctcagcgtccggccgaggcgcggtgtatgctgagccgctgccgcagccggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgagaaatatggctacacacacctttctgcaggagagctgcttcgtgatgaaaggaagaacccagattcacagtatggtgaacttattgaaaagtacattaaagaaggaaagattgtaccagttgagataaccatcagtttattaaagagggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaagcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctatttttttttaaattcaaaaagaatatcccttttatagtttgtgccttctgtgagcaaaactttttagtacgcgtatatatccctctagtaatcacaacattttaggatttagggatacccgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgctaaaaaaaaaaaaacaaaaaaaaaaaaaaaaattgtgtgtggggcggccggggcccggaaaaagtttttaaaccctttcgttgggggcgcgcgggcggggccccagtaggtgtaatggtggcactatgggcgtcatacagcgtggttcccaagaggaagaaatcgctcgggcctagcgaactagtgtgggtgtggggtttctccacccaatataaaaaaaaaagcgccggcggggaaacaaccgcggggttttctggaaaccaaattccagagatagggaggtccggaaaggcacatagggtttcttaccacgcgcgggtcccagagggagcggatataaatcagcgcaggggggggan

SEQ ID NO: 72963 - DNA, 3053 bp, Homo sapiens
  misc_feature (77)..(77): n is a, c, g, or t
acgcccgggcagccacggcggcggggccgcggcgggcgccggctcagcccgcccctttctcccgccgcctccccgcnccgccccgcgccgcgccggccgctgtcagctccctcagcgtccggccgaggcgcggtgtatgctgagccgctgccgcagccggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgagaaatatggctacacacacctttctgcaggagagctgcttcgtgatgaaaggaagaacccagattcacagtatggtgaacttattgaaaagtacattaaagaaggaaagattgtaccagttgagataaccatcagtttattaaagagggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaagcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctatttttttttaaattcaaaaagaatatcccttttatagtttgtgccttctgtgagcaaaactttttagtacgcgtatatatccctctagtaatcacaacattttaggatttagggatacccgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgctactttaaaaaaaaaaaaaaaactcaagggggggccgggccccaattcccttaagggggcgattaaaatacagggcccggtttaacacgtggacgggaaaccctgggttccccaattaacgcttggacaattcctttt

SEQ ID NO: 72964 - DNA, 2923 bp, Homo sapiens
  misc_feature (77)..(77): n is a, c, g, or t
  misc_feature (2895)..(2897): n is a, c, g, or t
  misc_feature (2900)..(2903): n is a, c, g, or t
  misc_feature (2905)..(2905): n is a, c, g, or t
acgcccgggcagccacggcggcggggccgcggcgggcgccggctcagcccgcccctttctcccgccgcctccccgcnccgccccgcgccgcgccggccgctgtcagctccctcagcgtccggccgaggcgcggtgtatgctgagccgctgccgcagccggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgagaaatatggctacacacacctttctgcaggagagctgcttcgtgatgaaaggaagaacccagattcacagtatggtgaacttattgaaaagtacattaaagaaggaaagattgtaccagttgagataaccatcagtttattaaagagggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaagcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctatttttttttaaattcaaaaagaatatcccttttatagtttgtgccttctgtgagcaaaactttttagtacgcgtatatatccctctagtaatcacaacattttaggatttagggatacccgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaaaatttattgagattatttactaaataattgatatacatccaacatcactgaatggaaataatttaaaaataagcaaggcttaaattnnntcnnnncnacatcactgaatgtcgac

SEQ ID NO: 72965 - DNA, 2980 bp, Homo sapiens
  misc_feature (77)..(77): n is a, c, g, or t
  misc_feature (2952)..(2954): n is a, c, g, or t
  misc_feature (2957)..(2960): n is a, c, g, or t
  misc_feature (2962)..(2962): n is a, c, g, or t
acgcccgggcagccacggcggcggggccgcggcgggcgccggctcagcccgcccctttctcccgccgcctccccgcnccgccccgcgccgcgccggccgctgtcagctccctcagcgtccggccgaggcgcggtgtatgctgagccgctgccgcagccggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgagaaatatggctacacacacctttctgcaggagagctgcttcgtgatgaaaggaagaacccagattcacagtatggtgaacttattgaaaagtacattaaagaaggaaagattgtaccagttgagataaccatcagtttattaaagagggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaagcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctatttttttttaaattcaaaaagaatatcccttttatagtttgtgccttctgtgagcaaaactttttagtacgcgtatatatccctctagtaatcacaacattttaggatttagggatacccgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagatagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgctaaaaatttattgagattatttactaaataattgatatacatccaacatcactgaatggaaataatttaaaaataagcaaggcttaaattnnntcnnnncnacatcactgaatgtcgac

SEQ ID NO: 72966 - DNA, 2863 bp, Homo sapiens
  misc_feature (77)..(77): n is a, c, g, or t
acgcccgggcagccacggcggcggggccgcggcgggcgccggctcagcccgcccctttctcccgccgcctccccgcnccgccccgcgccgcgccggccgctgtcagctccctcagcgtccggccgaggcgcggtgtatgctgagccgctgccgcagccggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgagaaatatggctacacacacctttctgcaggagagctgcttcgtgatgaaaggaagaacccagattcacagtatggtgaacttattgaaaagtacattaaagaaggaaagattgtaccagttgagataaccatcagtttattaaagagggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaagcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctatttttttttaaattcaaaaagaatatcccttttatagtttgtgccttctgtgagcaaaactttttagtacgcgtatatatccctctagtaatcacaacattttaggatttagggatacccgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgcta

SEQ ID NO: 72967 - DNA, 2578 bp, Homo sapiens
ctttttattacagtttgaaaaaaaataagcaggaaaaactgagtcatgaatgaattcttattatgctctgtacttatttaacctagtttatataaattgaaccacatgtttacgtttaaaaggactttgcatgttgattaatgaattagacacattgggtttattgcagggtttttttggtcatctctttaaactcttgttttctttgcaggttaaaagaatggcaaattcatatctatatttttaataactttgtatctctttttagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaagcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctatttttttttaaattcaaaaagaatatcccttttatagtttgtgccttctgtgagcaaaactttttagtacgcgtatatatccctctagtaatcacaacattttaggatttagggatacccgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgcta

SEQ ID NO: 72968 - DNA, 2243 bp, Homo sapiens
gcgagggccgctcgcgatctagaactaggtcaacaaagccaattattgacttatatgaagaaatggggaaagtcaagaaaatagatgcttctaaatctgttgatgaagtttttgatgaagttgtgcagatttttgacaaggaaggctaattctaaacctgaaagcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctatttttttttaaattcaaaaagaatatcccttttatagtttgtgccttctgtgagcaaaactttttagtacgcgtatatatccctctagtaatcacaacattttaggatttagggatacccgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgcta

SEQ ID NO: 72969 - DNA, 2381 bp, Homo sapiens
agcggctgcctagtatcttccgtactcttcgtcgactgctgactaatgagacttggctagttgaacgcactgtcgtctgcaggagggagacgacgacgctcgtgtgtatgcgtacgctgactgacaagagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaagcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctatttttttttaaattcaaaaagaatatcccttttatagtttgtgccttctgtgagcaaaactttttagtacgcgtatatatccctctagtaatcacaacattttaggatttagggatacccgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgcta

SEQ ID NO: 72970 - DNA, 2359 bp, Homo sapiens
gatttttgtatttttagtagagacggggttttgccatgttggccaggctggtcttgaactcctgaactcaagtggtcttcccacctcgacctcccaaagtgctgggattacagatgtgagccaccgcgccccgccaaatttgattatttttaataagaacttagctgtatggtattttaacagtacctgcttttaaaattattatcatctttttcctttacaggtttttgatgaagttgtgcagatttttgacaaggaaggctaattctaaacctgaaagcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctatttttttttaaattcaaaaagaatatcccttttatagtttgtgccttctgtgagcaaaactttttagtacgcgtatatatccctctagtaatcacaacattttaggatttagggatacccgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgcta

SEQ ID NO: 72971 - DNA, 1185 bp, Homo sapiens
gcgtccatagtagtgtacaagataagactatagagaacatcatctgcactctctggtgtcagaaaccaagtaacctatagatcataagtcgtctatgagaattagcttctagactataccctatacctctgcctcagttcgtgtcattccaggtacgatctgagtcaaggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgcta

SEQ ID NO: 72972 - DNA, 177 bp, Homo sapiens
acgatgtcttgagaggggaaagagtagtggtaggagtgatgacaacagagagagcttggaaaagaggtacttggcagtttttacatacaaccacttcaatcccagacctgccttatttggtacaggaataaaagagtcacatttaaacatgtaaaatggcttgtttaagatgttagg

SEQ ID NO: 72973 - DNA, 332 bp, Homo sapiens
ggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggc

SEQ ID NO: 72974 - DNA, 2917 bp, Homo sapiens
  misc_feature (77)..(77): n is a, c, g, or t
acgcccgggcagccacggcggcggggccgcggcgggcgccggctcagcccgcccctttctcccgccgcctccccgcnccgccccgcgccgcgccggccgctgtcagctccctcagcgtccggccgaggcgcggtgtatgctgagccgctgccgcagccggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgagaaatatggctacacacacctttctgcaggagagctgcttcgtgatgaaaggaagaacccagattcacagtatggtgaacttattgaaaagtacattaaagaaggaaagattgtaccagttgagataaccatcagtttattaaagagggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaagcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctatttttttttaaattcaaaaagaatatcccttttatagtttgtgccttctgtgagcaaaactttttagtacgcgtatatatccctctagtaatcacaacattttaggatttagggatacccgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgcta

SEQ ID NO: 72975 - DNA, 780 bp, Homo sapiens
  misc_feature (77)..(77): n is a, c, g, or t
acgcccgggcagccacggcggcggggccgcggcgggcgccggctcagcccgcccctttctcccgccgcctccccgcnccgccccgcgccgcgccggccgctgtcagctccctcagcgtccggccgaggcgcggtgtatgctgagccgctgccgcagccggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgagggatgacatcttgctatggtgcataggctgatctcaaactcctggcctcgagcaaccctctcgtcttgaccttccaaagtgctgagattacaggcatgagccacagtgcgtagtccctgtttttagaagtttgttcttcaagagattcttctagttgtaacatctaataatgatattttgctgtggctgttagtatagtatagtatgtgtagatgtcatttttggtagcatacatattatttctgttttataaataaacagatctaagaaagattaaataaattacccactgtcacactgggttgtgacagagttataaaactttagttttagttataaaaccttaagcactctagttcagtgttctgagtgtgtgatttcatgtaaggttcaggttcttgtgatctttgctgagttctttgtgtttctctaaatttatttccccattagtttgataattttgcaaatgctca

SEQ ID NO: 72976 - DNA, 2959 bp, Homo sapiens
  misc_feature (77)..(77): n is a, c, g, or t
acgcccgggcagccacggcggcggggccgcggcgggcgccggctcagcccgcccctttctcccgccgcctccccgcnccgccccgcgccgcgccggccgctgtcagctccctcagcgtccggccgaggcgcggtgtatgctgagccgctgccgcagccggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgagaaatatggctacacacacctttctgcaggagagctgcttcgtgatgaaaggaagaacccagattcacagtatggtgaacttattgaaaagtacattaaagaaggaaagattgtaccagttgagataaccatcagtttattaaagagggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaagcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctatttttttttaaattcaaaaagaatatcccttttatagtttgtgccttctgtgagcaaaactttttagtacgcgtatatatccctctagtaatcacaacattttaggatttagggatacccgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgctaaaaaaagggataaaaagttttgccctatagtgagtgtcgagc

SEQ ID NO: 72977 - DNA, 2863 bp, Homo sapiens
  misc_feature (77)..(77): n is a, c, g, or t
acgcccgggcagccacggcggcggggccgcggcgggcgccggctcagcccgcccctttctcccgccgcctccccgcnccgccccgcgccgcgccggccgctgtcagctccctcagcgtccggccgaggcgcggtgtatgctgagccgctgccgcagccggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgagaaatatggctacacacacctttctgcaggagagctgcttcgtgatgaaaggaagaacccagattcacagtatggtgaacttattgaaaagtacattaaagaaggaaagattgtaccagttgagataaccatcagtttattaaagagggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaagcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctatttttttttaaattcaaaaagaatatcccttttatagtttgtgccttctgtgagcaaaactttttagtacgcgtatatatccctctagtaatcacaacattttaggatttagggatacccgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagatagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgcta

SEQ ID NO: 72978 - DNA, 2859 bp, Homo sapiens
  misc_feature (77)..(77): n is a, c, g, or t
acgcccgggcagccacggcggcggggccgcggcgggcgccggctcagcccgcccctttctcccgccgcctccccgcnccgccccgcgccgcgccggccgctgtcagctccctcagcgtccggccgaggcgcggtgtatgctgagccgctgccgcagccggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgagaaatatggctacacacacctttctgcaggagagctgcttcgtgatgaaaggaagaacccagattcacagtatggtgaacttattgaaaagaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaagcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctatttttttttaaattcaaaaagaatatcccttttatagtttgtgccttctgtgagcaaaactttttagtacgcgtatatatccctctagtaatcacaacattttaggatttagggatacccgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgcta

SEQ ID NO: 72979 - DNA, 713 bp, Homo sapiens
  misc_feature (77)..(77): n is a, c, g, or t
acgcccgggcagccacggcggcggggccgcggcgggcgccggctcagcccgcccctttctcccgccgcctccccgcnccgccccgcgccgcgccggccgctgtcagctccctcagcgtccggccgaggcgcggtgtatgctgagccgctgccgcagccggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgagaaatatggctacacacacctttctgcaggagagctgcttcgtgatgaaaggaagaacccagattcacagtatggtgaacttattgaaaagtacattaaagaaggaaagattgtaccagttgagataaccatcagtttattaaagagggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagccgcgaatttagtagtagtagacggccgc

SEQ ID NO: 72980 - DNA, 123 bp, Homo sapiens
gtttgagacttccttctttttgcactcaacgttgttactaagattcatctacatttttttagttcattcctttttccatattgcatataattccatgggtgactataccctgatttcttcatc

SEQ ID NO: 72981 - DNA, 551 bp, Homo sapiens
acagcatggccataagttccctgggtgttctttttgtctcgtatatcccagagttgaggaagccagcaatctgaaaatgccaatggacacagacaaaggaagcctcaacaaaagcctgccttctaaagccaaaagaccaaaaaagaggcagaataggaagacaaaaaattttttaaacaataaccacactagaccagccaaataccacaggggaaaacaaacaaacaaacaaaactggctacaactccactcgtgccagcaaaggtcaagtgtggagcccagacttctacactcatgtggctgcaatgacgcaacacagtatcccttgccaagatggtgtcagaggaggccaaggatggagctgagcttttcatatcccctgaccagtaaggagccacctctcactctgggtttcagtagagtccacatggagagtctggctttccacacccacccaagagtaacaaggggtccctcctcctcccagtggggttggtgtcaaagaggtttgcagcagttggacatgcatgcacaaaaagaaaaaattaaac

SEQ ID NO: 72982 - DNA, 623 bp, Homo sapiens
gtttaaacaaatgaaaaagaagaatataatcagagttccagaagcctccttcttccattcaattacccctcacctttcagcataacttagtacattgacttctgacattacacatatgttagttttgccagttttaaaactttatgtatatgaaaccacacagtaagcttttattttttttggagacagggtctcactctgccgcccaggcagagtgccatcttggctcactgcaacctcagcctcccaagtagctgggactacaggcacatgccaccatgcccggctcattttttgtcattttagtagaaacggggtttcaacatgttggctaggctggtctcgaactcctgacctcaagtgacccacccgcctcggcctcccaaagtgctgggattacaggtgtgagccaccacgcttggtccccatgcagtaagctttaaaaaaaaaattctggtaaaatatacataacataaaatttaccctttttgccattttaaacatacagttcagtggtattaagtaccctcacattgttatgtggcatcaccaccactcatctctagaacgttttcatcttcccaaactctattgattaaacgttaactccctattcccctttc

SEQ ID NO: 72983 - DNA, 2346 bp, Homo sapiens
  misc_feature (2)..(2): n is a, c, g, or t
  misc_feature (6)..(6): n is a, c, g, or t
  misc_feature (8)..(9): n is a, c, g, or t
cngttncnntcctcaaaggattggctaaaagcaagcaactggattgaacaccctaagaagaaagattcacactgcaccaggagacatcagaaagaatgaaaactctgccgctgtttgtgtgcatctgtgcactgagtgcttgcttctcgttcagtgaaggtcgagaaagggatcatgaactacgtcacagaaggcatcatcaccaatcacccaaatctcactttgaattaccacattatcctggactgctagctcaccagaagccgttcattagaaagtcctataaatgtctgcacaaacgctgtaggcctaagcttccaccttcacctaataacccccccaaattcccaaatcctcaccagccacctaaacatccagataaaaatagcagtgtggtcaaccctaccttagtggctacaacccaaattccatctgtgactttcccatcagcttccaccaaaattactacccttccaaatgtgacttttcttccccagaatgccaccaccatatcttcaagagaaaatgttaacacaagctcttctgtagctacattagcaccagtgaattccccagctccacaagacaccacagctgccccacccacaccttctgcaactacaccagctccaccatcttcctcagctccaccagagaccacagctgccccacccacaccttctgcaactacacaagctccaccatcttcctcagctccaccagagaccacagctgccccacccacacctcctgcaactacaccagctccaccatcttcctcagctccaccagagaccacagctgccccacccacaccttctgcaactacaccagctccactatcttcctcagctccaccagagaccacagctgtcccacccacaccttctgcaactaccctagacccatcatccgcctcagctccaccagagaccacagctgccccacccacaccttctgcaactacaccagctccaccgtcttccccagctccacaagagaccacagctgccccaattaccacacctaattcttccccaactactcttgcacctgacacttctgaaacttcagctgcacccacacaccagactactacttcggtcactactcaaactactactactaaacaaccaacttcagctcctggccaaaataaaatttctcgatttcttttatatatgaagaatctactaaacagaattattgacgacatggtggagcaatagtatatgtatgtgtaaagtgttctgtcatttacaagatgtgattcatgagtgcagaactaccacctttcttttagcaccaatcccaacatgaaattatattactcagatttaaagcactatcattaatctttcaatctaattattcaccaccacaagacctattaacaagacaaaatgcctctatcccacaagccagatgcaggtctggggttcaaaataactctttggatcctacagagatagcctactgagggcaaagaaagtccttagataaagagagaatattgtatgggccatcaaccatttacttttccctgaatgttagaaactacaaaaccactaccttgtacccccatcaaaatcccacctgaaccatctaatcctataaacataaaggggtaaaattggaactctccagatgaacaaagacatctaaatatctgtagatagaaacatttatctatctaaatatattgatagacctgtcattgtattgattaatgacaaaaccctttagataattatcttccattttaaataaaattttatttcacaaatatgagccaagaaagaggaaagttgatttgaagtgaggattagaagtgaatgacaataaagtctggcagccaagcacgaaccaagactggcactatttttcttagtgtatataattgtttaaactgcaaggttgacatttattgtgttgtgtctaagttaatttcgatctaatgtacctgattctagcctctgtgaacaacaagaatatgtttgtgtatgttcacatggtgcttataatatttcactatcaattcaattaattcacataaattccatgtgaaatgtattcaacaatggaatattttctaaaacatttagtatacatttgaatgtattttaaaccatgccaaactactgctttaatgtcaagtttgcagaattgtctctgaaaataaaaaccctgactttagttgtaaaacaataaaagttagctacttggtatacggagatgttaatttgggatatggaggcatttttatcttctgtcactactacttaaaactctgatgattatgttagatttttttgctaactaataaagatttcaaatggcaattta

SEQ ID NO: 72984 - DNA, 1085 bp, Homo sapiens
ggagcaacaggcagttttaatgaatgcctgaaggcagaccttcaggccatttcaggccgaggcctaaaatggcatcagccccaaatgaggacgggcaggggttttacagtctcctgtaaacaggaagtgtttcagtctgtgtatctactgctacgtgatacccggtaggcctctctctgggtcttcagaacagctctctccccgcttctgctatcttgctgacgcacgctgatgacgtaagccgccttgcgccttgggactgggcctgagaagggaggagttattcaggcctccgccagcttctaggccctggggatggtctttcacctccctctttctgatctctttttcatgctcctccttgctccaaagaaaagccggatggcaaaagagcccagaacctattggaactgacaaaatcaagtcacggcgcctacaaagatgaggggcagattctggctgccttttaatttcgtccttcacctgatatctgtgccagagaatgataaaaatcataataaaggaaataatggaagaggagacttatgttactggggacatctaacataattattttcctgattcagtggcatggttcagtcttccaggagttctgctacagagaagagagtaacccccatccatcatggccaaagcacccagtcaggctccgctctggatccagcccgacaaatgcaacccttgaatagggtttgtgcaagcaaactggatgacgaccgaagaaaccctgtcgcttctgagaagacacccaatccaagaatgtgagttctggaaatgtcattaaatgtcagttatatacaaaaaaaaaaaaaaaaaaaaaaaaaaaaaaaaaaaaaaaaaagggggggggggccaaagagtttctcctggggggagcccgaggttttcgccgcgcccccggttttgttgtaccgaagggggcccctttggaggagaggcgcgtattattatgccacagcgccgggcccgggcgtttaacaccgtcgcgtgcggggaaagcggccacgcgggaccgctgtgcggaaggccctcctcggcggcggcgcacattgtgcgcacctcac

SEQ ID NO: 72985 - DNA, 404 bp, Homo sapiens
ggagcaacaggcagttttaatgaatgcctgaaggcagaccttcaggccatttcaggccgaggcctaaaatggcatcagccccaaatgaggacgggcaggggttttacagtctcctgtaaacaggaagtgtttcagtctgtgtatctactgctacgtgatacccggtaggcctctctctgggtcttcagaacagctctctccccgcttctgctatcttgctgacgcacgctgatgacgtaagccgccttgcgccttgggactgggcctgagaagggaggagttattcaggcctccgccagcttctaggccctggggatggtctttcacctccctctttctgatctctttttccggacgcgtgggtccggacgcgtgggcgacgcgtgggtcgacccacgcgtccg

SEQ ID NO: 72986 - DNA, 940 bp, Homo sapiens
ggagcaacaggcagttttaatgaatgcctgaaggcagaccttcaggccatttcaggccgaggcctaaaatggcatcagccccaaatgaggacgggcaggggttttacagtctcctgtaaacaggaagtgtttcagtctgtgtatctactgctacgtgatacccggtaggcctctctctgggtcttcagaacagctctctccccgcttctgctatcttgctgacgcacgctgatgacgtaagccgccttgcgccttgggactgggcctgagaagggaggagttattcaggcctccgccagcttctaggccctggggatggtctttcacctccctctttctgatctctttttcatgctcctccttgctccaaagaaaagccggatggcaaaagagcccagaacctattggaactgacaaaatcaagtcacggcgcctacaaagatgaggggcagattctggctgccttttaatttcgtccttcacctgatatctgtgccagagaatgataaaaatcataataaaggaaataatggaagaggagacttatgttactggggacatctaacataattattttcctgattcagtggcatggttcagtcttccaggagttctgctacagagaagagagtaacccccatccatcatggccaaagcacccagtcaggctccgctctggatccagcccgacaaatgcaacccttgaatagggtttgtgcaagcaaactggatgacgaccgaagaaaccctgtcgcttctgagaagacacccaatccaagaatatacagtcgaatgtaatttggaatttacgagtcttatcacattctcattctgcttgagcaattcaagatataagaaaaacagactgtctacatttcttcagagttcctccaactattggcttaaaattcctgaaattaaaattatagttctttgacat

SEQ ID NO: 72987 - DNA, 426 bp, Homo sapiens
ccgcttctgctatcttgctgacgcacgctgatgacgtaagccgccttgcgccttgggactgggcctgagaagggaggagttattcaggcctccgccagcttctaggccctggggatggtctttcacctccctctttctgatctctttttcatgctcctccttgctccaaagaaaagccggatggcaaaagagcccagaacctattggtgagttccacgtacgtcagcctccctgggaaaagtcaggcagagatgaaactggagggtgaaaagctatgagggtgaaagtggattgagtgggcccagtggaagacgcacagcaccgtggattccccttgcaagcttaaggcccgctagttggaatttaaggaaaagaaaacaataatttttttttttttttgagacggagtttcgctctcgtcacccg

SEQ ID NO: 72988 - DNA, 990 bp, Homo sapiens
ggagcaacaggcagttttaatgaatgcctgaaggcagaccttcaggccatttcaggccgaggcctaaaatggcatcagccccaaatgaggacgggcaggggttttacagtctcctgtaaacaggaagtgtttcagtctgtgtatctactgctacgtgatacccggtaggcctctctctgggtcttcagaacagctctctccccgcttctgctatcttgctgacgcacgctgatgacgtaagccgccttgcgccttgggactgggcctgagaagggaggagttattcaggcctccgccagcttctaggccctggggatggtctttcacctccctctttctgatctctttttcatgctcctccttgctccaaagaaaagccggatggcaaaagagcccagaacctattggaactgacaaaatcaagtcacggcgcctacaaagatgaggggcagattctggctgccttttaatttcgtccttcacctgatatctgtgccagagaatgtcttccaggagttctgctacagagaagagagtaacccccatccatcatggccaaagcacccagtcaggctccgctctggatccagcccgacaaatgcaacccttgaatagggtttgtgcaagcaaactggatgacgaccgaagaaaccctgtcgcttctgagaagacacccaatccaagaatgtgagttctggaaatgtcattaaatgtcagttatatacaaaaaaaaaaaaaaaaaaaaaaaaaaaaaaaaaaaaaaaaaagggggggggggccaaagagtttctcctggggggagcccgaggttttcgccgcgcccccggttttgttgtaccgaagggggcccctttggaggagaggcgcgtattattatgccacagcgccgggcccgggcgtttaacaccgtcgcgtgcggggaaagcggccacgcgggaccgctgtgcggaaggccctcctcggcggcggcgcacattgtgcgcacctcac

SEQ ID NO: 72989 - DNA, 346 bp, Homo sapiens
agaaaaataacaacccaataaaaacagtgagcaaaggacatgaacagacacttttcagaagaagacatgcatatggccaacaatcacatgaagaaaagctcaacatcactgattattacagaaaagtgaatcaaaaccacaataagataccatctcacaacagtcagtgtggctcttaccttatttttcctaaaaaatatggctttgttatgcctaatctaccttctttagtggtagatatgtgaatatgtggggaaagggtagatatgaagtctcaattacacaatttccagaaaaaaactgcactcatcaactgcctgtcttctctgttcagatttttgtgcaa

SEQ ID NO: 72990 - DNA, 704 bp, Homo sapiens
agtggcacaatctcggctcactgtaccctccgcctcccaggttcaagcagttctcatgcctcagcctcccaagtagctgggattgcaggtgcctgccgccacgcccggctaatttttgtattaatagagacagggtttcaccgtgttgggcaggctggtcctgaactcctgacctcaagtgatccacccgcctcggcctcccaaagtgctgggattacaggcgtgagccaccacacctggcctaggagttaagagtattaaatgttaagaacagaccaagtccatcaaacagctccacacccttgttccatgttctggattggggagttgtgggggtggaggtgtagaacttttaaaaagcttcttaaaataagttgctgtgaatacttcaggtatataaaaaaacattggttgacaataagccagtgttctgccattcttacctgcttatcaagacaaaacctgctcaagtccctgcccagctgcattccaagtgttttcaagtttggtggtaagacctgacctgaggcttcttataacctttactcagtgggaatatgcatacagttcactacagaaatatttgtgtttacttagaggaagtgccctggatctgggggcgggggggggcggggggaatgggtcttttctaaattgttaaaagcagttcatgccattattcttaataaacatttctaatatgc

SEQ ID NO: 72991 - DNA, 883 bp, Homo sapiens
tgtggaaccctgtattattagttccagtcctggaggcctgcctcctgagtttcccagctagttgggacaggccccaatatcccttcttcctgtaacccaaacagtcatgaatttgctttggcaggtggatggagacttgggaacttccacctcacccactaagccaggcccaggctatggggcattgtggctaaaccccaccaggtggatacttggtctgaggacgcatcttattctgggcctttagggagctaaggcagtgagaattggcaggaggactgctgtgaatgccttgtaggtcgggggattggagggggtcctctgctccctgtctctcaggatggcaatgtacctctcacccccagtgtcagctgaggtaggatccataatcagtaatattcctgcaacaaaatgttcctaagtggaatcaatgaagaccaaaatttatttgtataacaactctaaacctgctctgctctgctgtgtttacaatgtgctttgtgatcatccagcccagggagtcccagtctctggctgtctatctgctctaaggaagagagcccacagttctctatagtgccatagtctgtgatgaataaagttccagatttgaggtcaacccccgaccacccttaaagtgcttgttggtctcctgctttggtttgtcttcagcatccaactgatgcacatttgtcaagaacccagaggcttcttataacctttactcagtgggaatatgcatacagttcactacagaaatatttgtgtttacttagaggaagtgccctggatctgggggcgggggggggcggggggaatgggtcttttctaaattgttaaaagcagttcatgccattattcttaataaacatttctaatatgc

SEQ ID NO: 72992 - DNA, 696 bp, Homo sapiens
tgtggaaccctgtattattagttccagtcctggaggcctgcctcctgagtttcccagctagttgggacaggccccaatatcccttcttcctgtaacccaaacagtcatgaatttgctttggcaggtggatggagacttgggaacttccacctcacccactaagccaggcccaggctatggggcattgtggctaaaccccaccaggtggatacttggtctgaggacgcatcttattctgggcctttagggagctaaggcagtgagaattggcaggaggactgctgtgaatgccttgtaggtcgggggattggagggggtcctctgctccctgtctctcaggatggcaatgtacctctcacccccagtgtcagctgaggtaggatccataatcagtaatattcctgcaacaaaatgttcctaagtggaatcaatgaagaccaaaatttatttgtataacaactctaaacctgccagctgcattccaagtgttttcaagtttggtggtaagacctgacctgaggcttcttataacctttactcagtgggaatatgcatacagttcactacagaaatatttgtgtttacttagaggaagtgccctggatctgggggcgggggggggcggggggaatgggtcttttctaaattgttaaaagcagttcatgccattattcttaataaacatttctaatatgc

SEQ ID NO: 72993 - DNA, 1141 bp, Homo sapiens
tgtggaaccctgtattattagttccagtcctggaggcctgcctcctgagtttcccagctagttgggacaggccccaatatcccttcttcctgtaacccaaacagtcatgaatttgctttggcaggtggatggagacttgggaacttccacctcacccactaagccaggcccaggctatggggcattgtggctaaaccccaccaggtggatacttggtctgaggacgcatcttattctgggcctttagggagctaaggcagtgagaattggcaggaggactgctgtgaatgccttgtaggtcgggggattggagggggtcctctgctccctgtctctcaggatggcaatgtacctctcacccccagtgtcagctgaggtaggatccataatcagtaatattcctgcaacaaaatgttcctaagtggaatcaatgaagaccaaaatttatttgtataacaactctaaacctgctctgctctgctgtgtttacaatgtgctttgtgatcatccagcccagggagtcccagtctctggctgtctatctgctctaaggaagagagcccacagttctctatagtgccatagtctgtgatgaataaagttccagatttgaggtcaacccccgaccacccttaaagtgcttgttggtctcctgctttggtttgtcttcagcatccaactgatgcacatttgtcaagaacccactgaggctagaaaccccccaaacactcaaggtaccttgagaacatgtatcccaagacctgcaaagaccaaacacatggcctgtaactacttttcactttcaagccctggaacttgtctgtaccaaaaatctttctgaaccattcaccaaatctcttgtcaagggccagaataaattaagagattggcttttggttttcaattaggctttcaagtcctaagcccaacccctcctatcccacctaggcagaaatcacttcagatccttgcttcctagtttaatttcttctctgcctcagttataacatccataaaatggaaataataatacccacctcacacaggggttaggagtgtttttttgttggtttttttccagcctgggcaacagcgagactccatctcaaaaaaaaaggaaatgtgtatcaggaccatgatt

SEQ ID NO: 72994 - DNA, 1116 bp, Homo sapiens
tgtggaaccctgtattattagttccagtcctggaggcctgcctcctgagtttcccagctagttgggacaggccccaatatcccttcttcctgtaacccaaacagtcatgaatttgctttggcaggtggatggagacttgggaacttccacctcacccactaagccaggcccaggctatggggcattgtggctaaaccccaccaggtggatacttggtctgaggacgcatcttattctgggcctttagggagctaaggcagtgagaattggcaggaggactgctgtgaatgccttgtaggtcgggggattggagggggtcctctgctccctgtctctcaggatggcaatgtacctctcacccccagtgtcagctgaggtaggatccataatcagtaatattcctgcaacaaaatgttcctaagtggaatcaatgaagaccaaaatttatttgtataacaactctaaacctgctctgctctgctgtgtttacaatgtgctttgtgatcatccagcccagggagtcccagtctctggctgtctatctgctctaaggaagagagcccacagttctctatagtgccatagtctgtgatgaataaagttccagatttgaggtcaacccccgaccacccttaaagtgcttgttggtctcctgctttggtttgtcttcagcatccaactgatgcacatttgtcaagaacccactgaggctagaaaccccccaaacactcaaggtaccttgagaacatgtatcccaagacctgcaaagaccaaacacatggcctgtaactacttttcactttcaagccctggaacttgtctgtaccaaaaatctttctgaaccattcaccaaatctcttgtcaagggccagaataaattaagagattggcttttggttttcaattaggctttcaatttggtggtaagacctgacctgaggcttcttataacctttactcagtgggaatatgcatacagttcactacagaaatatttgtgtttacttagaggaagtgccctggatctgggggcgggggggggcggggggaatgggtcttttctaaattgttaaaagcagttcatgccattattcttaataaacatttctaatatgc

SEQ ID NO: 72995 - DNA, 1166 bp, Homo sapiens
tgtggaaccctgtattattagttccagtcctggaggcctgcctcctgagtttcccagctagttgggacaggccccaatatcccttcttcctgtaacccaaacagtcatgaatttgctttggcaggtggatggagacttgggaacttccacctcacccactaagccaggcccaggctatggggcattgtggctaaaccccaccaggtggatacttggtctgaggacgcatcttattctgggcctttagggagctaaggcagtgagaattggcaggaggactgctgtgaatgccttgtaggtcgggggattggagggggtcctctgctccctgtctctcaggatggcaatgtacctctcacccccagtgtcagctgaggtaggatccataatcagtaatattcctgcaacaaaatgttcctaagtggaatcaatgaagaccaaaatttatttgtataacaactctaaacctgctctgctctgctgtgtttacaatgtgctttgtgatcatccagcccagggagtcccagtctctggctgtctatctgctctaaggaagagagcccacagttctctatagtgccatagtctgtgatgaataaagttccagatttgaggtcaacccccgaccacccttaaagtgcttgttggtctcctgctttggtttgtcttcagcatccaactgatgcacatttgtcaagaacccactgaggctagaaaccccccaaacactcaaggtaccttgagaacatgtatcccaagacctgcaaagaccaaacacatggcctgtaactacttttcactttcaagccctggaacttgtctgtaccaaaaatctttctgaaccattcaccaaatctcttgtcaagggccagaataaattaagagattggcttttggttttcaattaggctttcaagtcctaagcccaacccctcctatcccacctaggcagaaatcacttcagatccttgcttcctagtttaatttgaggcttcttataacctttactcagtgggaatatgcatacagttcactacagaaatatttgtgtttacttagaggaagtgccctggatctgggggcgggggggggcggggggaatgggtcttttctaaattgttaaaagcagttcatgccattattcttaataaacatttctaatatgc

SEQ ID NO: 72996 - DNA, 855 bp, Homo sapiens
ttgctttttttcaggaaagggaagtggaggcttaaaccttggtaatttctttgcaagccgtaagggctacagtcgaaaagggtttgaccggcttagcactgagggcagtgaccaagagaaagaggatgatggagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcaataaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcaaagaatcagagtgta

SEQ ID NO: 72997 - DNA, 897 bp, Homo sapiens
taacagtaggaatcttttcataaccacacctcagtttgttcccagtgggcttagagggaggacctgatgattgattccaggatacttgtacttctaataacatttttcatgaatcatgagaaaatttccacagatacttcccttagaaaatttgctataaactctgtatcattggtagcacaaatttgagcgaggccttgtcaattttaaggtggaaataggaaggaccacaacatgacccgtaagtcaagaaggtagacatttcatatccagcttccttgcttagtctcctttcagtatttggcaataaaagctcgtgccgaattcggcacgagtagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcaataaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcaaagaatcagagtgta

SEQ ID NO: 72998 - DNA, 1015 bp, Homo sapiens
tgaaaagtctcaacatgtccagcagtttatacatccaaggttggattctggcagatcaatgccagataatttagattgtgaagaatgacagtctgaggaatgtaagcctgaattcttttttttatttttaattctttttttgtttgcttgtttgtttttttgagacaagatcttgctctgttgcccagactagagtgcagtagtgtgatcatagctcactgcagcctcagatggctcaaggaatcctcccacctcagcctcccaagtagctggggctgcagttgtgcatcagcatgcccagctcacatacaaagtattttaaatattgtaattaagaattaaaccaatgacagagaatagaggcctaaaaagatcactatacagatagaactagggcactctagagcaatggggaaaggcaatcctttaaacaaaaggttctaagacaattaggtagacatagagggaaaaaatgaaactgtttcctacaactcacaccgcaaaattctattccatgcgcattaaagttttaactgtaaaagccaggtgaggtggcatccctgtagtcgcagttactcaggaggctgaggtaggagaatcacttaaggccaggagtttgaggctgcagtgcactatgatagcacctgtgaatagccaccgtactccagcctgggcaatatactaaggtcctggctctacaaacatggagggggaaaaaaaagtttaactataaaaaataaaactacaaaagtttgaaactatgttcctgatattatgacatcactgtacggagggatttcaaaaacaagatacaaacctattaactgtaaggaaacattagtaaacatgactaccttaaaactgagaatttgtgttcatctaaaggcattccaaacagaatgtaaaagcaagccacagagtagaagatgaattgcaactttaaaaaatgaataaaggattaatattcagaaagtaggagctcctacagataattttttaaagatagcccagccaa

SEQ ID NO: 72999 - DNA, 384 bp, Homo sapiens
cggctaatttttgtatttttagtagagacggggtttcaccatgttggccaggctggtctcgaagtcctgacctcaggtgatccacccgcctcggccccccaaaatgctgggattacaggcgtgagccactgcgccctgccaaggacacatttttgtatcaaatggttaatgataaaattagacttaaaataacgtgaaaccttcaaatatcaaggggagaaaaacaggaaatgggtatctttgtttaaaaagcaagatgctataaacagcatatggtaacatactgtttttattaaacaaatttaaaatattagataatggtagataggttatatgataaccttataaacgtcatttcagtcggaaataaacttattaaacatt

SEQ ID NO: 73000 - DNA, 336 bp, Homo sapiens
ctctggaaggttgctagtagaatggacatgagaaaacacatgtttagtaatagtctttactccacagaatgtattcaacataaaaatgttatgattttttttcatatatcgttttaacactgaagcttttaagtgtccattaacagtgaacttaaaatattgaggtagacatttacatcaaattgagattgtcggatgtacattggtagaagaaattggtctagttacattttttaggctaaaaataactgctgacatttgtatattagactatcttgtgccataaaacggaagtttagaaaatttaggaaacaccttaccaaagtaggaaatttg

SEQ ID NO: 73001 - DNA, 2039 bp, Homo sapiens
  misc_feature (239)..(239): n is a, c, g, or t
  misc_feature (1469)..(1469): n is a, c, g, or t
  misc_feature (1566)..(1566): n is a, c, g, or t
  misc_feature (1656)..(1656): n is a, c, g, or t
  misc_feature (1799)..(1799): n is a, c, g, or t
  misc_feature (1968)..(1968): n is a, c, g, or t
gtcaacatcccagttgatgtcacagccaacagcctgcatcaagtgcctgacacgagccttggaagaggcggcaagggtggcagttcagggacagactgcctgggctggcgttctgatttgccgaaggtagtaagcaactatctctgtgaccttgaacaaagtactgaactgcatctctgtaaaatggggagaataatcattctacttcataggattgttatacgctataagcgctaacntatgtacaaccctgagacctgagcctagctcacaataagggctctgagtttgctgttgttattgttgttgttgattattacggttgttgttgtttttattgttattagaaagactccactttgtcaggctgctctgtctccatcctattgccctctccaggtgcctatacagagtcagcccttgtgctgctcatttacaaatagctgcttggtgtctcccctcatctccactcctctggattccagaacttcccacacaggagcccagccctggacagtgacggtgacccatggagaatgcatcatgcctgtcagggtcctgttggttcagcggctggggaggcagtgccctgctgggaacgatcacttcccatgaagatggatggctttctctgtcccggcgacactaactgcgagagatgggggaacctgctgcaggagggaaggggcagtttgtattaagtggtcactgggcccagtggggaagtatgaggggggcatggaggcttatttcactgtttcaataacaccagccttgcagactgacaagacttctcccctcggagagctaactgctcagccgtccacgtgtttctttgcacactggtaaagcccaggggttaccggcatgcattttggaatcagctggcttgtgaataagtccttgctttgccgtttccttggctgctaaatttggacccactatttaacttccctttggtctctgtttcttaatgaaataatagtatccaccttgttaagttacgctgtgaagtctgagagacctgcatgtgaagccctaagagaggctggagagcaggggtgccaaacgtgttcagtaatggatcagcagatcaatcttttgggctctgtggtccgtaagatctctgttgcagatactcaactctgccagtgtagccccaaagcagccatagataatagatacataatcaggcatggttgtgttctaataaaactttacataaaaagcaggcaacggtgagattttgcctgtgggttgtagtttgtaagccctggactaaagcctagtcctcaagagcaggggccatggatcccggctgcacctgggtttagatctcagctctgacactcacaagctgtgtgagctttcttcacctgctggcagttgtaagaattttgtgagtcatacattgataggccaaggacttgcaatggtgtttaggaaacgttaaacacaacttaagtgtntgctctcattttcattattacagagtgagtataaaacaggtcccaggccaggtgcggtggctcatgcctgccttggcctcccacagtgtggggattncagtcttgagccaccgggcccgtccatgaggtaaaatctttaaagtgcctgtcatcttagtaggtgctaaatacaggttactactagacntcataacttcaaattctgtacgtggacctgttcttttgtctcttctgagtacagtctcctgaagattgttctgaccaaacctttctatggagaaaacagagctgttattgctttaagtgatttgtagggtgttttggtttcantaaaatgtgtatggagaggtgacattgtcttagggatcaaaaagattaaacagcaaacctgctatttttctgtgtacactttcaggaaaatcatttcaatttatgttttaaaagacgctaagtgacagcgatgcctcatttgaaatcagaaagaatgaactttcattcnacacaaccatatgctttctttgatggcttgaatggttagggaatatgtgacattaaattcagcagtttccc

SEQ ID NO: 73002 - DNA, 650 bp, Homo sapiens
cacttcagaaatgatattgtgtacttccatcaggagatatgtaatatcttcttgtctctttttgtgatataaacagcctttaaggatcattgttcagaacattatttcattaaggtttgtaaaatataaaagacccccttttatcagtcatttgccttctttgaggaatagttcctacaggaaaggcaagatagatgcttggatatttcccttatttaccagttttcaaaataatgagttgctcactatcaccctgcaaaagttaccatgaggtttggtttttgtttattttgtttgtagtattactgtgagctaacaggaatttaaacatatttgagatatttcagtcaattgaggttatgtatccttcttggtatacaaattgtgccattttcggtcagtgaaagcctcttcaagtggatttcccaggtcctttggttgtgaccttaatataagtgtttgatagttttcctgctctctgataggcaagatagtctgtgtgtttatactgattcttggaatttagattaagtacaacaaggtttttacttcgttttatcattttcacacctgtaccttctttctcccacaccaaaaatcccatttctcaatattgttaagaatttattctttgtcctatgtcatactcc

SEQ ID NO: 73003 - DNA, 258 bp, Homo sapiens
agatacctcatttttcccccaactaactcagtatgcttttccacttcaaggcactgcccaatcctgtagctgcagatttaaataatacacaaaataattgtagatgaaacttaaatgaaaccaaaatgaagaaaacaaaataagttctttagtcataatgtctaccacaaataaaagcaattcagagattttcaatggtaggaattacctttatctttacaataacaagtttctattcttaaaatggaatggtctgca

SEQ ID NO: 73004 - DNA, 582 bp, Homo sapiens
agggttattgtatttcaggttcatggcttcccttaggatatgagctcagaatgtttggtttcttgtaagagatacacatatttttattataaatgtatgaatattgaacacataattatgtgaacattgatcacctccatgaatgactctctgcaagagacttctatatgcaaagtaccacagcaggtggagctacaatgaaggttcaggacttgtgtctcccaataaataacatctcatatgtaaaatgctcatctcctggatgagcatcctggtgatgtgatcctcatctgtttccccagaacaataaaaataagctatccttcatgtacaaagaaaatgtggcgaacccagtattggtggcacgtgactttgacatttcttgtttctttcagctgtagtaatagctcttttctgaattatctattgttgaactgtccaatatggtagccactatataaatgttactattgagcacttgaaattaggctagtccaattgagatgtgctgtcagtttaaaacacatactgatttccgaatcagcaccaaaaaagaatacaaataatatttattacatgttg

SEQ ID NO: 73005 - DNA, 320 bp, Homo sapiens
ggcagaggttgtagtgagccaagattgtgccattgcactccagcctgggcaacgagagcaagactccttctcaaaaaaaaaaaaaaaaaaaaaaaaagattaattaagttcctgtcagccaattttactgcccccatttcacagatgaggagcttgaggcttagagagagaagtcacctgcccagggtcacacagcaaatgaatggaggaaccagattccaaaccctcatctgattgactaccaaactagtcattatgttcacctgtatagatggttaaccatctgcagggcagttgtccttacccaacaaacattcctg

SEQ ID NO: 73006 - DNA, 194 bp, Homo sapiens
agctccccacgtcggtttccctgtttgatgatgaagatgaagaggataatctttttgggcgtacagctgctaagaggcagacattgtgtctacaagctcagagagaagagaaagcaaaagcctccgagctctccaaaaagaaagcatctgccctgttgttcagcagtgatgaggaggtgagctgaggtttctgc

SEQ ID NO: 73007 - DNA, 253 bp, Homo sapiens
ctgggccctacacatgcttcaagttacaggatctgggtgatggtcccggccaatgtcctccagtaacccccagctgagcctggcctccccagcagatgtttcctgcaatggaaagttgctggccagggctccacatggaggcgtggagtagggaggggaggtggcagggcactgctgttaggatgaaatctgaaatgtgagactcaagttgccagggacttcttggagacactctcacacctcaccaacccat

SEQ ID NO: 73008 - DNA, 416 bp, Homo sapiens
ttgcaattgacaagcatcttagtctctccgggctggtataacaaaatagcatagatggtgggcttagaaacagcagtcatttatttctcagatctaggggcggggaggccataatcaaggcaccggcagacccggcatctggtgagggcccgctcctggttcatagacagcaccctctgccatgtcctcacacggtggaacagggaggggcctctcggcgtctccttcatagaggaaccaatcccttccccgagggctcccgctcatggccaatcacttcccaaagaccccgcttcctaatactaccaccttggcgtgaggattttaaccgatggattgggggaaacacaaacgttccagccgtagcacgttatttggccgaaacccagaataccaggaggccagccctcgctctg

SEQ ID NO: 73009 - DNA, 294 bp, Homo sapiens
agcctctcagtagtttgtttgtttgtttgttttactccagcctgggcgacaagagcgaaactccatctcaaaataaaataaaaataaataaattgacacagtcagtgcctcgctcccacccccacctccagcatagcaccatgacagtcttctcacataacaagtcccaaaacacaccatcggcatccagaaagtgagagtaactcgttacagttgagacctctcactcccggtcattatctcatttcaatccaagaggtagacttcttcatcgcccctgacatacacatgagg

SEQ ID NO: 73010 - DNA, 357 bp, Homo sapiens
gtatttgcaaaatgcatttcttcacagaaattaatatcctgtgcaaatgctggctaattgattattactctttcataaaggcttaattaggtaggaaacccagtacctgcagcgagagaggaagaaaagtctttcctagggctagatcctgacccaaggttttggattttaatggggcagagttgtctgttttctattaaacacatacttgggagtaagtagacttgcccatctcctgttttatactgatcttttcacgaatgtgaacctttttcttgaaagagtaaatatctttaaatttttctgtagccttccctgttacaagttaaatgttcctacttctctagagtatttcga

SEQ ID NO: 73011 - DNA, 474 bp, Homo sapiens
ccagaaaccaagcctcctgtattcttgtgggcagcccacatgcgggttgaaactttgggtgcacccacctcttttacagctgcagccacggctctactcaattccccttcaccgccaatctgtcctcaccaatcagccctctcccaccgaatcacactcttcctcaaactcagtttatttgctttgccagtacaggaactaagtcaacaagagggctggcgtgcagtatgtcctgtcaaacgggcggctgctaaatgagaacacgtaatccaaacatgcatctccgcagtgagtgcacagcatgatcctccaacattcctttgcgattaggggtcattgtgcttccccacattcgggtcagaagattctacccaggagggaagacctgggacaggcaccaggatcatgcattttgggctcctggaggcactggatatctctgtgacaggcaccaggatcatgcattttgggctc

SEQ ID NO: 73012 - DNA, 3844 bp, Homo sapiens
tgagatggagtttcactcttgttggccaggctggagtgcaatggcacaatctcagcttactgcaacctccgcctcccgggttcaagcgattctcctgcctcagcctctcaagtagctgggattacaggcatgtgccaccacccctggctaactaatttcttttctatttagtagagatggggtttcaccatgttggtcaggctggtcttgaactcctgacctcaggtgatccacttgccttggcctcccaaagtgctaggattacagccgtgaaactgtgcctggctgattctttttttgttgttggatttttgaaacagggtctcccttggtcgcccaggctggagtgcagtggtgcgatcttggctcactataacctccacctcctggtttcaagtgatcctcccactttagcctcctgagtagctgtgattacaggcgtgcaccaccacacccggctaatttttgtatttttattagagacagggtttcaccatgttggccaggctgttctcaaactcctggactcaagggatccgcctgcctccacttcccaaagtcccgagattacaggtgtgagtcaccatgcctgaccttataattcttaagtcattttttctggtccatttcttccttagggtcctcacaacaaatctgcattaggcggtacaataatccttaacttcatgattcacaaaaggaagatgaagtgattcatgatttagaaaggggaagtagtaagcccactgcacactcctggatgatgatcctaaatccagatacagtaaaaatggggtatgggaaggtagaatacaaaatttggtttaaattaattatctaaatatctaaaaacatttttggatacattgttgatgtgaatgtaagactgtacagacttcctagaaaacagtttgggttccatcttttcatttccccagtgcagttttctgtagaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgcaagaaatttgcttttgttcatatatcttttgcacaatttgaactgtcacaaggtaatgtcaaaaaaagtaaacaacttcttcaaaaagctgtagaacgtggagcagtaccactagaaatgctggaaattgccctgcggaatttaaacctccaaaaaaagcagctgctttcagaggaggaaaagaagaatttatcagcatctacggtattaactgcccaagaatcattttccggttcacttgggcatttacagaataggaacaacagttgtgattccagaggacagactactaaagccaggtttttatatggagagaacatgccaccacaagatgcagaaataggttaccggaattcattgagacaaactaacaaaactaaacagtcatgcccatttggaagagtcccagttaaccttctaaatagcccagattgtgatgtgaagacagatgattcagttgtaccttgttttatgaaaagacaaacctctagatcagaatgccgagatttggttgtgcctggatctaaaccaagtggaaatgattcctgtgaattaagaaatttaaagtctgttcaaaatagtcatttcaaggaacctctggtgtcagatgaaaagagttctgaacttattattactgattcaataaccctgaagaataaaacggaatcaagtcttctagctaaattagaagaaactaaagagtatcaagaaccagaggttccagagagtaaccagaaacagtggcaagctaagagaaagtcagagtgtattaaccagaatcctgctgcatcttcaaatcactggcagattccggagttagcccgaaaagttaatacagagcagaaacataccacttttgagcaacctgtcttttcagtttcaaaacagtcaccaccaatatcaacatctaaatggtttgacccaaaatctatttgtaagacaccaagcagcaataccttggatgattacatgagctgttttagaactccagttgtaaagaatgactttccacctgcttgtcagttgtcaacaccttatggccaacctgcctgtttccagcagcaacagcatcaaatacttgccactccacttcaaaatttacaggttttagcatcttcttcagcaaatgaatgcatttcggttaaaggaagaatttattccatattaaagcagataggaagtggaggttcaagcaaggtatttcaggtgttaaatgaaaagaaacagatatatgctataaaatatgtgaacttagaagaagcagataaccaaactcttgatagttaccggaacgaaatagcttatttgaataaactacaacaacacagtgataagatcatccgactttatgattatgaaatcacggaccagtacatctacatggtaatggagtgtggaaatattgatcttaatagttggcttaaaaagaaaaaatccattgatccatgggaacgcaagagttactggaaaaatatgttagaggcagttcacacaatccatcaacatggcattgttcacagtgatcttaaaccagctaactttctgatagttgatggaatgctaaagctaattgattttgggattgcaaaccaaatgcaaccagatacaacaagtgttgttaaagattctcaggttggcacagttaattatatgccaccagaagcaatcaaagatatgtcttcctccagagagaatgggaaatctaagtcaaagataagccccaaaagtgatgtttggtccttaggatgtattttgtactatatgacttacgggaaaacaccatttcagcagataattaatcagatttctaaattacatgccataattgatcctaatcatgaaattgaatttcccgatattccagagaaagatcttcaagatgtgttaaagtgttgtttaaaaagggacccaaaacagaggatatccattcctgagctcctggctcatccatatgttcaaattcaaactcatccagttaaccaaatggccaagggaaccactgaagaaatgaaatatgttctgggccaacttgttggtctgaattctcctaactccattttgaaagctgctaaaactttatatgaacactatagtggtggtgaaagtcataattcttcatcctccaagacttttgaaaaaaaaaggggaaaaaaatgatttgcagttattcgtaatgtcagataggaggtataaaatatattggactgttatactcttgaatccctgtggaaatctacatttgaagacaacatcactctgaagtgttatcagcaaaaaaaattcagtgagattatctttaaaagaaaactgtaaaaatagcaaccacttatggcactgtatatattgtagacttgttttctctgttttatgctcttgtgtaatctacttgacatcattttactcttggaatagtgggtggatagcaagtatattctaaaaaactttgtaaataaagttttgtggctaaaatga

SEQ ID NO: 73013 - DNA, 1231 bp, Homo sapiens
gattttcagagtgagagaaaagaggctcctgggattcagtcttttagcgaacactaaactgagcatttgaatgtaaaggctttgcaattctacaagaatagcactcaactattttaagtatttataggtccggttcacggacgtgttatgcaccatttaagccattttctacatggtttacttgggcagagcatagaatgcaatgtgccaagaggcaagtgcaacccacgtcactcatatttctttggtgtaagtggcaagcttttggtcaggagcttgaactgagaaagcaagcagaaagcagagtaagctcaggcagtagaaaaatgggcagaacggttcagatgtacatgttacagcttttattaacatctcggcttcccatcataatgcctattaatttcaacagtgggtacactttgggcatcaaaaagaacataaacatcacatgctattatttgacaaggcagttttataacttgtcaccaggaagtgctggtgaggaaggaaatatttcacggaagcattatttaaaaataaataaatgtaatttttaaaatactgtcagcatagctaacataaaaggcacccttggttaccctactttcattcttacttataaaatcccaaccttaactgttctgtgatggagagagagatactgctgttttgattggcccactgctaactgaaaactatcctgcaatcttgggtataaatcaaccttagcaacctttgacaatgagattttagatcctttggaaaacagaagtcatctagaaattcagccagtggatcctcctttcctgacacatcattctgcataaaattaggtgattgtcttcctctgctcttggcccaggatagaaacaggttgtataataaagtagttctccccttgcctttccataggccacctgtccctcagctaaatcagaaagataaaagttagatgcggccaggcgcagtggctcacaccggtaatcccagcactttgggaggccgaggcgggtggatcatgaggtcaagagatcgagaccatcctggccaacatggtgaaaccccctctccactaaaaatacaaaaattagccgggcgtggtgcgcatgcctgtagtccctactactcaggaggccaaggcaaaagaatcgcttgaacccggggggcggagtttgtggtgagccgagatcacaccactgcactccaacctggcgacagaacgagcttctgc

SEQ ID NO: 73014 - DNA, 533 bp, Homo sapiens
gatggctgctggaagtgaatagctcctctggaagatgagtggtgtctcctgaagctgagtatctgcgtgtctgtgaccttgtagtttctacttccagatgtggtcaagagaactgtgaatgtgtgtgcaccagaaacatccactgggacattcatagcacccttctcatgacatctccactccacaggccacccaaaatgagtgagagagtaaaatgtggagtgtctgcgcactgggatgctccacagcaatgggaatgaacagcctgctcagacacacatcaacttgggttgcctcagggaccttacgccaagcaggagatgccagacacagagtccatcctgagagagtctgttcctgtccaagctcagaaacacaggaagccacctgtgctgtagcagcacacggagatgcatcctttctggtccaccccacggccctcattgcagtcagggatcctctcccagaaagtccctgctgccagcccctgcccttccagggtgcactctggacgttgcttccgtgactggtct

SEQ ID NO: 73015 - DNA, 518 bp, Homo sapiens
ggtcactctagtcaataagcacaccaaaaattcccaagtctaatatatttctttgtttccttatttttattctcttctctctcaacttaccggagactcttgtatggccatcggaaaattaacctacttaacttgatttgcaacaaggctgagtccctctgtttgcctgagaaaatataatgggccagtttttttcagtcttcttttttaccatgtgaattccagaagcagtcagctcttataatcctaggagctccccaaatttctgaattttctatttccattcatttctgccctcaaatctgtcagtgcttgcctgtgcacatttcttatttataatctttgataagtgcaacaagtagtactttgttgttccttttttttttttccaccctgtcgctcaggctggagtgcagtggcacaatcttggctcactgcaacctctgccttccgggttcaagtgattctcctgtctcagcctccccagtagctggaactacaggcacccgccaccacgc

SEQ ID NO: 73016 - DNA, 239 bp, Homo sapiens
cttcgcaatataaataccctgtgtcatctgctaccaatagatttttgtaagtactagatttctcagcaacatttagtgccattgactacttttcctgcttgaaactcttctcattattttcatgatactgtctgtgctttcctcattagtgatctctgtgtcttttgcaaatgtttctcctttacaaccattaagtaatagaagttcgtagcattttgttcttaactcttctctagact

SEQ ID NO: 73017 - DNA, 1903 bp, Homo sapiens
ataacatcctgtgcgctgctgagctgagctggggcgcggccgcctgtctgcaccggcagcaccatgttgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctccaa

SEQ ID NO: 73018 - DNA, 1852 bp, Homo sapiens
ataacatcctgtgcgctgctgagctgagctggggcgcggccgcctgtctgcaccggcagcaccatgttgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctccaa

SEQ ID NO: 73019 - DNA, 1618 bp, Homo sapiens
ataacatcctgtgcgctgctgagctgagctggggcgcggccgcctgtctgcaccggcagcaccatgttgctcatggtcgtcagcatggcgtgtgttgggttcttcttggtccagagggccggtccacacgtgggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctccaa

SEQ ID NO: 73020 - DNA, 1482 bp, Homo sapiens
  misc_feature (121)..(122): n is a, c, g, or t
  misc_feature (233)..(236): n is a, c, g, or t
  misc_feature (306)..(306): n is a, c, g, or t
  misc_feature (405)..(405): n is a, c, g, or t
  misc_feature (682)..(682): n is a, c, g, or t
  misc_feature (947)..(947): n is a, c, g, or t
  misc_feature (976)..(976): n is a, c, g, or t
  misc_feature (1041)..(1041): n is a, c, g, or t
  misc_feature (1270)..(1270): n is a, c, g, or t
  misc_feature (1319)..(1320): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggatngctcctgactctgatgggcatcctcactcctcagacatttccaatctcccccacttcatgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatcctaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggtgagtatccctaaagagcaggggtcgcagtctaga

SEQ ID NO: 73021 - DNA, 607 bp, Homo sapiens
  misc_feature (6)..(6): n is a, c, g, or t
ctcggnctctaccttgtctgcgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatctacttgaaaataataaagtggcatttctttatgaaaaaaaaagaaatctcttccataattcagatttctacactttatacttgcctccctcctaaatcgtgatattgaaatatggtg

SEQ ID NO: 73022 - DNA, 6841 bp, Homo sapiens
  misc_feature (121)..(122): n is a, c, g, or t
  misc_feature (233)..(236): n is a, c, g, or t
  misc_feature (306)..(306): n is a, c, g, or t
  misc_feature (405)..(405): n is a, c, g, or t
  misc_feature (682)..(682): n is a, c, g, or t
  misc_feature (947)..(947): n is a, c, g, or t
  misc_feature (976)..(976): n is a, c, g, or t
  misc_feature (1041)..(1041): n is a, c, g, or t
  misc_feature (1270)..(1270): n is a, c, g, or t
  misc_feature (1319)..(1320): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggatngctcctgactctgatgggcatcctcactcctcagacatttccaatctcccccacttcatgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatcctaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatctacttgaaaataataaagtggcatttctttatgaaaaaaaaagaaatctcttccataattcagatttctacactttatacttgcctccctcctaaatcgtgatattgaaatatggtg

SEQ ID NO: 73023 - DNA, 5636 bp, Homo sapiens
gcaagaatccatctcttaaaaaaaaatctaggactctcctagaatccttgataaaataatctgaaggaagagagatggggaaaaaacagttgaggtgtctttccagggagcttatccagactgcctccaggggagatgttatggccctaaccataggtgttgtctcaatccaatataattaggggtcaagcccagtcaaacccttctcagccctcaagccctccaagttgcatcacaaatgccacctcctccatgtggtctctcctgatggtcccccaccccttccaaccaggtgggactttccttctgggcattcttcccatgcccgggagctgaagggatgggcatggtgactggctgggttggctccggatgcgtgcccctacgcctctccttgctccctcagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatctacttgaaaataataaagtggcatttctttatgaaaaaaaaagaaatctcttccataattcagatttctacactttatacttgcctccctcctaaatcgtgatattgaaatatggtg

SEQ ID NO: 73024 - DNA, 6790 bp, Homo sapiens
  misc_feature (121)..(122): n is a, c, g, or t
  misc_feature (233)..(236): n is a, c, g, or t
  misc_feature (306)..(306): n is a, c, g, or t
  misc_feature (405)..(405): n is a, c, g, or t
  misc_feature (682)..(682): n is a, c, g, or t
  misc_feature (947)..(947): n is a, c, g, or t
  misc_feature (976)..(976): n is a, c, g, or t
  misc_feature (1041)..(1041): n is a, c, g, or t
  misc_feature (1270)..(1270): n is a, c, g, or t
  misc_feature (1319)..(1320): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggatngctcctgactctgatgggcatcctcactcctcagacatttccaatctcccccacttcatgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatcctaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatctacttgaaaataataaagtggcatttctttatgaaaaaaaaagaaatctcttccataattcagatttctacactttatacttgcctccctcctaaatcgtgatattgaaatatggtg

SEQ ID NO: 73025 - DNA, 3813 bp, Homo sapiens
gtatccaggctgtgccactgaatacccatgtaaccttggagatgtcacattcccttcctgagcctccattttctcaccacaaaattaggatgccatctccactgctgtaggagtgggatgtgagtaaagaaactagcccagggcctagcaaactgcacttacaactgcgatgatcccatggtgaggatttagactcacattctcaaggagaaatgggggaagtgagtactgaggagaggagaactgaagcaacaggggaagcaggctcagcagggagcctgcaggctgcggtggtgaagagaggcagggggcaggaggggctggtacaggtgccaggggtcagctgtctctgtccccacccaccctccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatctacttgaaaataataaagtggcatttctttatgaaaaaaaaagaaatctcttccataattcagatttctacactttatacttgcctccctcctaaatcgtgatattgaaatatggtg

SEQ ID NO: 73026 - DNA, 6788 bp, Homo sapiens
  misc_feature (121)..(122): n is a, c, g, or t
  misc_feature (233)..(236): n is a, c, g, or t
  misc_feature (306)..(306): n is a, c, g, or t
  misc_feature (405)..(405): n is a, c, g, or t
  misc_feature (682)..(682): n is a, c, g, or t
  misc_feature (947)..(947): n is a, c, g, or t
  misc_feature (976)..(976): n is a, c, g, or t
  misc_feature (1041)..(1041): n is a, c, g, or t
  misc_feature (1270)..(1270): n is a, c, g, or t
  misc_feature (1319)..(1320): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggatngctcctgactctgatgggcatcctcactcctcagacatttccaatctcccccacttcatgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatcctaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggcttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatctacttgaaaataataaagtggcatttctttatgaaaaaaaaagaaatctcttccataattcagatttctacactttatacttgcctccctcctaaatcgtgatattgaaatatggtg

SEQ ID NO: 73027 - DNA, 6191 bp, Homo sapiens
  misc_feature (121)..(122): n is a, c, g, or t
  misc_feature (233)..(236): n is a, c, g, or t
  misc_feature (306)..(306): n is a, c, g, or t
  misc_feature (405)..(405): n is a, c, g, or t
  misc_feature (682)..(682): n is a, c, g, or t
  misc_feature (947)..(947): n is a, c, g, or t
  misc_feature (976)..(976): n is a, c, g, or t
  misc_feature (1041)..(1041): n is a, c, g, or t
  misc_feature (1270)..(1270): n is a, c, g, or t
  misc_feature (1319)..(1320): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggatngctcctgactctgatgggcatcctcactcctcagacatttccaatctcccccacttcatgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatcctaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctcaacgctgcatgacctatctaggtcgctctctacagacattcccagtgccttctaagccaagacatg

SEQ ID NO: 73028 - DNA, 5851 bp, Homo sapiens
  misc_feature (121)..(122): n is a, c, g, or t
  misc_feature (233)..(236): n is a, c, g, or t
  misc_feature (306)..(306): n is a, c, g, or t
  misc_feature (405)..(405): n is a, c, g, or t
  misc_feature (682)..(682): n is a, c, g, or t
  misc_feature (947)..(947): n is a, c, g, or t
  misc_feature (976)..(976): n is a, c, g, or t
  misc_feature (1041)..(1041): n is a, c, g, or t
  misc_feature (1270)..(1270): n is a, c, g, or t
  misc_feature (1319)..(1320): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggatngctcctgactctgatgggcatcctcactcctcagacatttccaatctcccccacttcatgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatcctaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgcttactgtcattgcccgcttgttgaccagccggaattgtcctg

SEQ ID NO: 73029 - DNA, 1747 bp, Homo sapiens
cagagtagctataaaagggtacacaaggaaggtctctgtgataatggaacagcgctgtatcctgacgacggtagtattacatcaatctatacatataataaaattgcctatgcacacacaggcacacacaaatgggctcatgtaaagagtgatgccggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatctacttgaaaataataaagtggcatttctttatgaaaaaaaaagaaatctcttccataattcagatttctacactttatacttgcctccctcctaaatcgtgatattgaaatatggtg

SEQ ID NO: 73030 - DNA, 1241 bp, Homo sapiens
gctatagaacaatgcgtctagaaccgttatggacaaagaaggataaaagtactgtaagaagagttgtgcatattttcatgtgagtagcaggtggcgtcgatgcacatgctaagtcctcagacaagactttgggagaggacggagatcaagatggaagaagatagtgagtgaggctgtatgcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatctacttgaaaataataaagtggcatttctttatgaaaaaaaaagaaatctcttccataattcagatttctacactttatacttgcctccctcctaaatcgtgatattgaaatatggtg

SEQ ID NO: 73031 - DNA, 2475 bp, Homo sapiens
  misc_feature (121)..(122): n is a, c, g, or t
  misc_feature (233)..(236): n is a, c, g, or t
  misc_feature (306)..(306): n is a, c, g, or t
  misc_feature (405)..(405): n is a, c, g, or t
  misc_feature (682)..(682): n is a, c, g, or t
  misc_feature (947)..(947): n is a, c, g, or t
  misc_feature (976)..(976): n is a, c, g, or t
  misc_feature (1041)..(1041): n is a, c, g, or t
  misc_feature (1270)..(1270): n is a, c, g, or t
  misc_feature (1319)..(1320): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggatngctcctgactctgatgggcatcctcactcctcagacatttccaatctcccccacttcatgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatcctaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggtgagaagccaggctgccccctgtaggaaagagtctgaatcctgaatccatagtcaggatgaagggctctggtagtacttacctggcaaaagctctgccattggtggggcaattgaggggtcagggggccctgaatattatggaaacaccctccacagagcagggtattgactgagggcagcctgactccatgggaaatgtatctcccttccccagggagatctctgttctgtccaccccaagacttgagtggatttcaaagctttcaggtattgggttaagaaccccttacg

SEQ ID NO: 73032 - DNA, 1928 bp, Homo sapiens
  misc_feature (121)..(122): n is a, c, g, or t
  misc_feature (233)..(236): n is a, c, g, or t
  misc_feature (306)..(306): n is a, c, g, or t
  misc_feature (405)..(405): n is a, c, g, or t
  misc_feature (682)..(682): n is a, c, g, or t
  misc_feature (947)..(947): n is a, c, g, or t
  misc_feature (976)..(976): n is a, c, g, or t
  misc_feature (1041)..(1041): n is a, c, g, or t
  misc_feature (1270)..(1270): n is a, c, g, or t
  misc_feature (1319)..(1320): n is a, c, g, or t
  misc_feature (1808)..(1808): n is a, c, g, or t
  misc_feature (1814)..(1814): n is a, c, g, or t
  misc_feature (1830)..(1830): n is a, c, g, or t
  misc_feature (1842)..(1842): n is a, c, g, or t
  misc_feature (1902)..(1902): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggatngctcctgactctgatgggcatcctcactcctcagacatttccaatctcccccacttcatgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatcctaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttctggagccttccaggccctgctgcatcttttctagccactacagnctctgnctttcctttcacaggncagcttctttgnggcctggctacacttgcttggctttccttccttcacttccaatttcctcttccccactgntttcctggactcgctctcttccgtgg

SEQ ID NO: 73033 - DNA, 1843 bp, Homo sapiens
  misc_feature (121)..(122): n is a, c, g, or t
  misc_feature (233)..(236): n is a, c, g, or t
  misc_feature (306)..(306): n is a, c, g, or t
  misc_feature (405)..(405): n is a, c, g, or t
  misc_feature (682)..(682): n is a, c, g, or t
  misc_feature (947)..(947): n is a, c, g, or t
  misc_feature (976)..(976): n is a, c, g, or t
  misc_feature (1041)..(1041): n is a, c, g, or t
  misc_feature (1270)..(1270): n is a, c, g, or t
  misc_feature (1319)..(1320): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggatngctcctgactctgatgggcatcctcactcctcagacatttccaatctcccccacttcatgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatcctaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaaggtgagtggaggggcttctagggaaggaacaaaagaggcaagaaaaccatgcagcatcaaggtggcaggagccttaaaactgtaatccagccttctttacagatgaggaaactgaggcccagaaacaaggactggcccaaggacatgcagctagttggtggcacagccagaactagaatttggatcccctgcatcctagcccaaagctctctccctgtataccctagaagcca

SEQ ID NO: 73034 - DNA, 6642 bp, Homo sapiens
  misc_feature (121)..(122): n is a, c, g, or t
  misc_feature (233)..(236): n is a, c, g, or t
  misc_feature (306)..(306): n is a, c, g, or t
  misc_feature (405)..(405): n is a, c, g, or t
  misc_feature (682)..(682): n is a, c, g, or t
  misc_feature (947)..(947): n is a, c, g, or t
  misc_feature (976)..(976): n is a, c, g, or t
  misc_feature (1041)..(1041): n is a, c, g, or t
  misc_feature (1270)..(1270): n is a, c, g, or t
  misc_feature (1319)..(1320): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggatngctcctgactctgatgggcatcctcactcctcagacatttccaatctcccccacttcatgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatcctaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatatttgtttagagggtgggcattgttttaggttttaccccaaaaaacaaattctttttttcaggccaacttttaggaaaaatatttcttttttaaaaaaaacca

SEQ ID NO: 73035 - DNA, 3848 bp, Homo sapiens
tcggtacccccccgactagcccgacagggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatctacttgaaaataataaagtggcatttctttatgaaaaaaaaagaaatctcttccataattcagatttctacactttatacttgcctccctcctaaatcgtgatattgaaatatggtg

SEQ ID NO: 73036 - DNA, 6134 bp, Homo sapiens
  misc_feature (121)..(122): n is a, c, g, or t
  misc_feature (233)..(236): n is a, c, g, or t
  misc_feature (306)..(306): n is a, c, g, or t
  misc_feature (405)..(405): n is a, c, g, or t
  misc_feature (682)..(682): n is a, c, g, or t
  misc_feature (947)..(947): n is a, c, g, or t
  misc_feature (976)..(976): n is a, c, g, or t
  misc_feature (1041)..(1041): n is a, c, g, or t
  misc_feature (1270)..(1270): n is a, c, g, or t
  misc_feature (1319)..(1320): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggatngctcctgactctgatgggcatcctcactcctcagacatttccaatctcccccacttcatgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatcctaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaacacaacacaccggcgttggcttggagagctccacaagggggcgaggggggtcccctccagggaaatgccttgaaaacgggagacatgtggcacctttacccggcgcggaaacgatggtcaaggtccacaacggagaaagtttttccca

SEQ ID NO: 73037 - DNA, 2878 bp, Homo sapiens
cacggcattagtagtgtctggtagagacgtgtcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatctacttgaaaataataaagtggcatttctttatgaaaaaaaaagaaatctcttccataattcagatttctacactttatacttgcctccctcctaaatcgtgatattgaaatatggtg

SEQ ID NO: 73038 - DNA, 4707 bp, Homo sapiens
  misc_feature (121)..(122): n is a, c, g, or t
  misc_feature (233)..(236): n is a, c, g, or t
  misc_feature (306)..(306): n is a, c, g, or t
  misc_feature (405)..(405): n is a, c, g, or t
  misc_feature (682)..(682): n is a, c, g, or t
  misc_feature (947)..(947): n is a, c, g, or t
  misc_feature (976)..(976): n is a, c, g, or t
  misc_feature (1041)..(1041): n is a, c, g, or t
  misc_feature (1270)..(1270): n is a, c, g, or t
  misc_feature (1319)..(1320): n is a, c, g, or t
cactcgctggcttcccctcactccatctctgtgcccagagaaacaggggtactccaggggaatcctgtcctctgactgttcccagtagaaggcgggagcagaattttttcttttctctctnncccttctggttccccttcctctctgtgcccctcatcctttggattactcatcaaatgagcagcaacaacacccctagaccagctggtcctgtcctgggtcatctcgttgtnnnnagtttctagctggtataaggttaaagataccctttccagccccagcaaagccttaggcatttctgggatngctcctgactctgatgggcatcctcactcctcagacatttccaatctcccccacttcatgcagctttgcttccccttccccactggaagaaggaaacantcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactntggagaggttacatctggcagggtttggggacacctcttgcctccatctcaaacttccgctgcctccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatnaattcaaattgtttaatctctctgagccncagtttacccacttggaaaagaagagttaggccacatggtctctgtcatcctgggattctgagtnaactgctccccttcagccagatcctaggggcatatccccccaacctgggacccaggcccccttcccttgcagcctctctcagttgtgagtgcacaggccagagggggttgagaggagccaagggggggcatgccgtgggacaaacgggctgtctagggccagtggctaaaggggcgggaggggaggagtcctcagggatcctgtttcaacaaacgtttctttcggaggnggggaaggcgggggagagggggagaaggacctatttaaagctaccctgnngctttggctttctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggtaagcccctccacattccccccagcaaagtgcaagccccaccaccagctcctccctccaggaccacacgcagactccactcccactactggttcctgcttctgttcctcaacaccctcagatcctggggtcccaggtcccaggagccctgactctttcgaacctgttgtctctgccctcttcccatcagattctaaaccccgcctaactcacagttggtctccgaggccctccacctt

SEQ ID NO: 73039 - DNA, 332 bp, Homo sapiens
gggcaagtgccgaagcgcaggcatcaaggtactggcctcccatcctcccctccattctagcctcccccatgccagagttcaaggagctgcagtggctgctgccctggaaaggcccaggccacggtggcctccttcccactgactcagagaagaagctgtccatctgcaaggaaaggcccacccctgccttggggcactcacccttatcccttttgctcagagaggccagtgtcccatgcccctcctctccctccctggcacagctctttgtcccatctgcatgtgtacccttccattctgatttgaagcataatctggcactcctatcttga

SEQ ID NO: 73040 - DNA, 869 bp, Homo sapiens
ccgctgctggcggggcgtttgcagtggcccttgtgaactatgtttctgccgttaccagtgttggacccgccttcctcttttcctagaaaaggcgcagatgcgtggtcgcaaactgatttccaagtccgttgtctgatgctgcgagacactatccgtttgttacagcgaattgggggccgatgacgctggaggtggaagaagccgcggttctgtttcttaatggcgaattagcctgcggacttcctgtcattcccttgccttttagcgtcccaacttagcaaaactccgcgtttagggtgttctgagtaggctttgtctaccctgaaacgctttgtgtcgacattccaccaggtctgttccacggtccaaacttctctaccttttttgaccctctagaattgtgttacgattagtagtatattgtgtcgagagtctgggatctttgatgttagttatattccctggctgtttatgccaaagggaaatccaaatagtaatttattacgtacattacgtataattcaaattaaaattttgtaagaacagttgccaaccacgctaccctacatgcctgctgtgtatcttctcggcgtccctcgattctgttttgcttcccaaagtacttgagccctttccgtcataaaaagtaaagatgaaaaatatatttggagcatgatacttacatgcggaagtcttaacaggacataaattgtgtgcttttggctgctttcattagatttttaattttttccttttaccaccactgaaaaaaatacaaatacagtggattaaggttaaattaaaaagcactagtagaaattaaaagattgcaagactacaaaaaaataaactggcatttctggtgtaag

SEQ ID NO: 73041 - DNA, 1039 bp, Homo sapiens
taaaataagataactttaatgtgagatccttcccataagcagaaaatacaagcaattaacaacatcaacaacaacaacaaacccacaatactttctaggatttgaggccagaaaagtagagttggttggtatcaacactgttcttcccttcagggcttcagggtttatttccattcttaagctatttaatgagtacaaactatttgaaaacatctcgaggcagcttttgctttcccaaccatttcaccctgtccttctaccttaagccctgatgaagagatttcaaaaactccctttgagtgtgttagaaaagcttagaaactgactttacgattacaactcaaaaatgtttacaagatctttagataatagtgtatgcgcagaaagatgaggaaacctctgaccaagaagtctagacacagattaagggcccaggagggcagagccagtccttaaacaatatagacaccatgtctcctgtgtttacagggatagctcataggtacagccatcagggttggattgcctccaaaagtaggccctacaaactcccgtaggccagggcctggcagtataccccattctcaccaccatcctttgaagaaagttctaagagttaaggttatcccacaggctactaggtagatttccaaatggcctcagggaaagtggaattctgccaacagtaaaggcaactccccaaacagtgctaatgctgagaggatcaagggaaggactttgatatacacatatatgtatggataaaagagttaagctacgtaacatgaaacaccaaaaatatacttgctggtacatcaagagttcctcacaaacactctgaagttaaaatctaaaatgctccactttttacccaaaatataaatgactcaacctcattttgtattatatactaacacagaaatgagttttttaaaaaggttggctgctatctatctaaagcaaacagtttatgttttacacataaaaaaatttatttgcataaaagtttttatggaactaaaaaatatgttctctacaa

SEQ ID NO: 73042 - DNA, 409 bp, Homo sapiens
tttggttatataaaaaattaatttataaataatttttgttgtacaggagtatgatagggtgatcaataaaaatcctgcaaacataaaattacattacattgggacaaaaatttttgcagaaagtggaatgggagtataaatttgagggaaaataaagaataatgtaaatgtttcaattattacattagattttacatatatgtatacgtacacatatatacataaatccacatatataaatattttagacagatgatggttatcaaactacttatgcatttttttggtatttctttgaatacatgtaaaacaataatggaaaattttacctcttgctgtcagtatttataatatactgtcagccctctgtatctgtgacttcatatccacggacccaaccaattgtgga

SEQ ID NO: 73043 - DNA, 1735 bp, Homo sapiens
  misc_feature (1684)..(1684): n is a, c, g, or t
ttaacggtaggtgcgaggctgggtgtgaatcggccgaggcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccncacaagcctttcatcaacatcttaaaatagtaactgtgctcagcttgtaaa

SEQ ID NO: 73044 - DNA, 2196 bp, Homo sapiens
  misc_feature (29)..(29): n is a, c, g, or t
  misc_feature (43)..(43): n is a, c, g, or t
  misc_feature (57)..(57): n is a, c, g, or t
  misc_feature (68)..(68): n is a, c, g, or t
  misc_feature (2145)..(2145): n is a, c, g, or t
gattcctgcagcaggccgatggggcaggnagcagcccctgccntaggaggtccctgncccattccccnacccctccccggtccaggattcccaggggcaggccccctggtgcctgcagattctcatcctggggtgcatcaggaagcactttgctcatcagctcacctccacaagtttggaggggctaagatgtcagcctccaaaaggggacagcaggctgggcgaggtggctcatgcctgtaatcccagcactttgggaggccgaggagggtggatcacctgaggtcaggagttccagaccagcctggccaacatggtgaaaccctatctctactaaaaatacgggtgtggtggagggcacctgtaatcccagctactagggaggctgaggcagaattgcttgaacccaggaggcagaggatgcagtgagccgagatcgcactattgcactccagcctgggcaacaagagcaagactccatctcaaacaacaacaaaaacccaaaaggggacagcagtagtgggagaggccagcatctgtacaccccatcagggtccccgctgtgtgtgcccctcaggcggccaccagccctaccaggtcctcccctcccggcaggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccncacaagcctttcatcaacatcttaaaatagtaactgtgctcagcttgtaaa

SEQ ID NO: 73045 - DNA, 1559 bp, Homo sapiens
  misc_feature (1542)..(1542): n is a, c, g, or t
ggccacgcccccggcgggtggagtcgggcggggcgccgggcaggttcctctgcgttccgcggcggcggcagcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgtttaaaanaaacataaaaaaaaaaa

SEQ ID NO: 73046 - DNA, 1562 bp, Homo sapiens
ggccacgcccccggcgggtggagtcgggcggggcgccgggcaggttcctctgcgttccgcggcggcggcagcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgtttcacccctctcattcaaaaaaaaaaa

SEQ ID NO: 73047 - DNA, 2187 bp, Homo sapiens
  misc_feature (2136)..(2136): n is a, c, g, or t
tcggttaatgagaaaaaacttaaccggaggatgccatgtcgacccacgcgtccgggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcaggtatctgcctgtggcacctccatttgatcttgggggaggcattaactctagggttccgcagctgggagggtctcggcctctctgggaggggcagggagcagctcactcctccagggcatttttaggaaagggttttcagctagtgtttttccgtgcttgaatggcaccagccctgcctggggtagctagaagctgagtggacctgcagcacacccgagcagatgggctttgcctctgccccttttgtcccctaggctgtctgctgtggcccaccctgccaaggcccgagtgtgggggactttggaggtggctcccggcccggcttccaagtcctcccctccatagtgtggaggctcccccgggaggtccctgccctacctgcccgcgtcccctcccagagtcctggaaagcccctccctttccatggaactgacgcttcacccgtcctcccccagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccncacaagcctttcatcaacatcttaaaatagtaactgtgctcagcttgtaaa

SEQ ID NO: 73048 - DNA, 1800 bp, Homo sapiens
  misc_feature (1749)..(1749): n is a, c, g, or t
ttaacggtaggtgcgaggctgggtgtgaatcggccgaggcggcggcgacggcgacatggagagcggggcctacggcgcggccaaggcgggcggctccttcgacctgcggcgcttcctgacgcagccgcaggtggtggcgcgcgccgtgtgcttggaggcagaggatgcagtgagccgagatcgcactattgcactccagcctgggcaacaagagcaagactccatctcaaacaacaacaaaaacccaaaaggggacagcagtagtgggagaggccagcatctgtacaccccatcagggtccccgctgtgtgtgcccctcaggcggccaccagccctaccaggtcctcccctcccggcaggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccncacaagcctttcatcaacatcttaaaatagtaactgtgctcagcttgtaaa

SEQ ID NO: 73049 - DNA, 1708 bp, Homo sapiens
  misc_feature (1657)..(1657): n is a, c, g, or t
ttaacggtaggtgcgaggctgggtgtgaatcggccgaggcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccncacaagcctttcatcaacatcttaaaatagtaactgtgctcagcttgtaaa

SEQ ID NO: 73050 - DNA, 1165 bp, Homo sapiens
  misc_feature (1114)..(1114): n is a, c, g, or t
cggtcgctcggtcgcgaatccaggtcggtcgcgaatccaggttcggtcgcgaatccaggtcggcgcgaatccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccncacaagcctttcatcaacatcttaaaatagtaactgtgctcagcttgtaaa

SEQ ID NO: 73051 - DNA, 1121 bp, Homo sapiens
  misc_feature (1070)..(1070): n is a, c, g, or t
tccgacggcccctgggttggtttagaatcggacgaggctgtggaaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccncacaagcctttcatcaacatcttaaaatagtaactgtgctcagcttgtaaa

SEQ ID NO: 73052 - DNA, 1480 bp, Homo sapiens
  misc_feature (1429)..(1429): n is a, c, g, or t
ggccacgcccccggcgggtggagtcgggcggggcgccgggcaggttcctctgcgttccgcggcggcggcagcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccncacaagcctttcatcaacatcttaaaatagtaactgtgctcagcttgtaaa

SEQ ID NO: 73053 - DNA, 1021 bp, Homo sapiens
  misc_feature (27)..(27): n is a, c, g, or t
  misc_feature (970)..(970): n is a, c, g, or t
tgagtgatctagcaggatcttaaggtngttgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccncacaagcctttcatcaacatcttaaaatagtaactgtgctcagcttgtaaa

SEQ ID NO: 73054 - DNA, 854 bp, Homo sapiens
  misc_feature (803)..(803): n is a, c, g, or t
ggctatcaaaaaggaagagtgggaggaggaggggaagcggcgaaggaggaagaggaggaggaggaggagcttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccncacaagcctttcatcaacatcttaaaatagtaactgtgctcagcttgtaaa

SEQ ID NO: 73055 - DNA, 1500 bp, Homo sapiens
  misc_feature (1449)..(1449): n is a, c, g, or t
ggccacgcccccggcgggtggagtcgggcggggcgccgggcaggttcctctgcgttccgcggcggcggcagcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccncacaagcctttcatcaacatcttaaaatagtaactgtgctcagcttgtaaa

SEQ ID NO: 73056 - DNA, 1020 bp, Homo sapiens
ggccacgcccccggcgggtggagtcgggcggggcgccgggcaggttcctctgcgttccgcggcggcggcagcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgggtcagcacctctggagccttcctgggacacggccttggccgtccagcccacccctcggagataaggcccatctctggaagaggtcaaggccctaaagcaacttctggcttcttcttttgagcaatgacagagggagctgtcatcggcaagtcccgattgtttaaaaatccccagtacgaactaacagggcactgctcccagcctcacccgatggctttggcttgggacacatcactagcgaagg

SEQ ID NO: 73057 - DNA, 895 bp, Homo sapiens
ggccacgcccccggcgggtggagtcgggcggggcgccgggcaggttcctctgcgttccgcggcggcggcagcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgttgggcgataactatttatcgcccacacaaagacaggaactaacacaaaatcaaagaaagagtcataaaaagtagaagtacaaaagtcagggtgttgggaaacagtcacgcgaccgac

SEQ ID NO: 73058 - DNA, 776 bp, Homo sapiens
ttaacggtaggtgcgaggctgggtgtgaatcggccgaggcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctgggtgtgctggaaaagaagctgaaggtgatggctgccctcacagagtcggccttcaccagcacgtccttcgggtttggtgactgcccagggctaggtgaggaagcagaaaccagcagaaccacagggcagggaccaagagacgctgagaccgcagcccgtgacacacatagacaaggcaacgtgcggctagctgacgtgcccacaagcggacagacaacacaggcatacgaccagaaagccaggag

SEQ ID NO: 73059 - DNA, 562 bp, Homo sapiens
ttaacggtaggtgcgaggctgggtgtgaatcggccgaggcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggcgaagcagtgctaagctcctgagagtcagc

SEQ ID NO: 73060 - DNA, 375 bp, Homo sapiens
  misc_feature (324)..(324): n is a, c, g, or t
gcggccgcctactactactgctcgaattcaagcttctaacgatgtacggggaatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccncacaagcctttcatcaacatcttaaaatagtaactgtgctcagcttgtaaa

SEQ ID NO: 73061 - DNA, 1767 bp, Homo sapiens
  misc_feature (1716)..(1716): n is a, c, g, or t
ggccacgcccccggcgggtggagtcgggcggggcgccgggcaggttcctctgcgttccgcggcggcggcagcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccncacaagcctttcatcaacatcttaaaatagtaactgtgctcagcttgtaaa

SEQ ID NO: 73062 - DNA, 1732 bp, Homo sapiens
  misc_feature (1681)..(1681): n is a, c, g, or t
tcggttaatgagaaaaaacttaaccggaggatgccatgtcgacccacgcgtccgggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccncacaagcctttcatcaacatcttaaaatagtaactgtgctcagcttgtaaa

SEQ ID NO: 73063 - DNA, 1575 bp, Homo sapiens
ggccacgcccccggcgggtggagtcgggcggggcgccgggcaggttcctctgcgttccgcggcggcggcagcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgtttactgctgggtgttggctggtggagtggtgtggggggca

SEQ ID NO: 73064 - DNA, 1627 bp, Homo sapiens
  misc_feature (1576)..(1576): n is a, c, g, or t
ggccacgcccccggcgggtggagtcgggcggggcgccgggcaggttcctctgcgttccgcggcggcggcagcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccncacaagcctttcatcaacatcttaaaatagtaactgtgctcagcttgtaaa

SEQ ID NO: 73065 - DNA, 1859 bp, Homo sapiens
  misc_feature (1808)..(1808): n is a, c, g, or t
ggccacgcccccggcgggtggagtcgggcggggcgccgggcaggttcctctgcgttccgcggcggcggcagcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggtgggtaggatggccaggggccggttcttgggtcaagggtggtggagggtggggtcccccagccacctgtaccctgctgtgctccccctgcagggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccncacaagcctttcatcaacatcttaaaatagtaactgtgctcagcttgtaaa

SEQ ID NO: 73066 - DNA, 1683 bp, Homo sapiens
  misc_feature (1632)..(1632): n is a, c, g, or t
ggccacgcccccggcgggtggagtcgggcggggcgccgggcaggttcctctgcgttccgcggcggcggcagcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccncacaagcctttcatcaacatcttaaaatagtaactgtgctcagcttgtaaa

SEQ ID NO: 73067 - DNA, 1360 bp, Homo sapiens
ggccacgcccccggcgggtggagtcgggcggggcgccgggcaggttcctctgcgttccgcggcggcggcagcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggggggaaggttttgccatcttggggatcctcatagagatcagactcta

SEQ ID NO: 73068 - DNA, 1640 bp, Homo sapiens
  misc_feature (1589)..(1589): n is a, c, g, or t
ggccacgcccccggcgggtggagtcgggcggggcgccgggcaggttcctctgcgttccgcggcggcggcagcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccncacaagcctttcatcaacatcttaaaatagtaactgtgctcagcttgtaaa

SEQ ID NO: 73069 - DNA, 1116 bp, Homo sapiens
ggccacgcccccggcgggtggagtcgggcggggcgccgggcaggttcctctgcgttccgcggcggcggcagcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcataagtagggcgagctcgatgatt

SEQ ID NO: 73070 - DNA, 1396 bp, Homo sapiens
  misc_feature (1345)..(1345): n is a, c, g, or t
ggccacgcccccggcgggtggagtcgggcggggcgccgggcaggttcctctgcgttccgcggcggcggcagcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccncacaagcctttcatcaacatcttaaaatagtaactgtgctcagcttgtaaa

SEQ ID NO: 73071 - DNA, 1340 bp, Homo sapiens
  misc_feature (1289)..(1289): n is a, c, g, or t
ggccacgcccccggcgggtggagtcgggcggggcgccgggcaggttcctctgcgttccgcggcggcggcagcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccncacaagcctttcatcaacatcttaaaatagtaactgtgctcagcttgtaaa

SEQ ID NO: 73072 - DNA, 712 bp, Homo sapiens
  misc_feature (698)..(700): n is a, c, g, or t
ttaacggtaggtgcgaggctgggtgtgaatcggccgaggcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagagtgttaagatcnnntaatcaccacgc

SEQ ID NO: 73073 - DNA, 566 bp, Homo sapiens
ttaacggtaggtgcgaggctgggtgtgaatcggccgaggcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggactccgaagcagtggacgggatcctcaaagtacc

SEQ ID NO: 73074 - DNA, 564 bp, Homo sapiens
atctcttgaagcttcacttcaacttcactacttctgtagtctcatcttgagtaaaagagaacccagccaactatgaagttccttgtctttgccttcatcttggctctcatggtttccatgattggagctgattcatctgaagagaaatttttgcgtagaattggaagattcggttatgggtatggcccttatcagccagttccagaacaaccactatacccacaaccataccaaccacaataccaacaatataccttttaatatcatcagtaactgcaggacatgattattgaggcttgattggcaaatacgacttctacatccatattctcatctttcataccatatcacactactaccactttttgaagaatcatcaaagagcaatgcaaatgaaaaacactataatttactgtatactctttgtttcaggatacttgccttttcaattgtcacttgatgatataattgcaatttaaactgttaagctgtgttcagtactgtttctgaataatagaaatcacttctctaaaagcaataaatttcaagcacatttttacatgt

SEQ ID NO: 73075 - DNA, 530 bp, Homo sapiens
atctcttgaagcttcacttcaacttcactacttctgtagtctcatcttgagtaaaagagaacccagccaactatgaagttccttgtctttgccttcatcttggctctcatggtttccatgattgctgattcatctgaagagaaatttttgcgtagaattggaagattcggttatgggtatggcccttatcagccagttccagaacaaccactatacccacaaccataccaaccacaataccaacaatataccttttaatatcatcagtaactgcaggacatgattattgaggcttgattggcaaatacgacttctacatccatattctcatctttcataccatatcacactactaccactttttgaagaatcatcaaagagcaatgcaaatgaaaaacactataatttactgtatactctttgtttcaggatacttgccttttcaattgtcacttgatgatataattgcaatttaaaacctgtaaaaccctgtggtcaaaaaacggggattttgaaaataaattaaaaaa

SEQ ID NO: 73076 - DNA, 321 bp, Homo sapiens
agcgcagctagctgcgagaattaatgtgaattgcaggacatgattattgaggcttgattggcaaatacgacttctacatccatattctcatctttcataccatatcacactactaccactttttgaagaatcatcaaagagcaatgcaaatgaaaaacactataatttactgtatactctttgtttcaggatacttgccttttcaattgtcacttgatgatataattgcaatttaaactgttaagctgtgttcagtactgtttctgaataatagaaatcacttctctaaaagcaataaatttcaagcacatttttacatgt

SEQ ID NO: 73077 - DNA, 561 bp, Homo sapiens
atctcttgaagcttcacttcaacttcactacttctgtagtctcatcttgagtaaaagagaacccagccaactatgaagttccttgtctttgccttcatcttggctctcatggtttccatgattgctgattcatctgaagagaaatttttgcgtagaattggaagattcggttatgggtatggcccttatcagccagttccagaacaaccactatacccacaaccataccaaccacaataccaacaatataccttttaatatcatcagtaactgcaggacatgattattgaggcttgattggcaaatacgacttctacatccatattctcatctttcataccatatcacactactaccactttttgaagaatcatcaaagagcaatgcaaatgaaaaacactataatttactgtatactctttgtttcaggatacttgccttttcaattgtcacttgatgatataattgcaatttaaactgttaagctgtgttcagtactgtttctgaataatagaaatcacttctctaaaagcaataaatttcaagcacatttttacatgt

SEQ ID NO: 73078 - DNA, 534 bp, Homo sapiens
atctcttgaagcttcacttcaacttcactacttctgtagtctcatcttgagtaaaagagaacccagccaactatgaagttccttgtctttgccttcatcttggctctcatggtttccatgattggagctgattcatctgaagagtatgggtatggcccttatcagccagttccagaacaaccactatacccacaaccataccaaccacaataccaacaatataccttttaatatcatcagtaactgcaggacatgattattgaggcttgattggcaaatacgacttctacatccatattctcatctttcataccatatcacactactaccactttttgaagaatcatcaaagagcaatgcaaatgaaaaacactataatttactgtatactctttgtttcaggatacttgccttttcaattgtcacttgatgatataattgcaatttaaactgttaagctgtgttcagtactgtttctgaataatagaaatcacttctctaaaagcaataaatttcaagcacatttttacatgt

SEQ ID NO: 73079 - DNA, 528 bp, Homo sapiens
  misc_feature (1)..(3): n is a, c, g, or t
nnnttaccgatggcactgtcaccaaacctatgcactaaaaagttccttgtctttgccttcatcttggctctcatggtttccatgattggagctgattcataagaagagaaatttttgcgtagaattggaagattcggttatgggtatggcccttatcagccagttccagaacaaccactatacccacaaccataccaaccacaataccaacaatataccttttaatatcatcagtaactgcaggacatgattattgaggcttgattggcaaatacgacttctacatccatattctcatctttcataccatatcacactactaccactttttgaagaatcatcaaagagcaatgcaaatgaaaaacactataatttactgtatactctttgtttcaggatacttgccttttcaattgtcacttgatgatataattgcaatttaaactgttaagctgtgttcagtactgtttctgaataatagaaatcacttctctaaaagcaataaatttcaagcacatttttacatgt

SEQ ID NO: 73080 - DNA, 394 bp, Homo sapiens
aaagcagtagtgttctgctcaatgacttagctaaatatgccaagctgcgcacgtggctattgaatgtttgtgcaccctggtattaaaccctctgttctgttccttttcttgtatgggaaaagcaagagaatacattatttgataaagacctcctgtggcttgtttcagtacgtgggacgtgtgtgtttaagagagggaaagcactgctactagcagtgacactggccatacagattttgtttctgtgagccccagggaaagtgcagtagtgatgatgataatgggcctgagctagttcttgtctcaaagggctccatttcctgccggttcaggtggtagattattattaatccatcccaaaggaaagcagctttcccaactcaattacatatca

SEQ ID NO: 73081 - DNA, 353 bp, Homo sapiens
atatcttgctgtaagtcttctagctatatttttgtatttgggtttatatatttttccatttgcatgtcaaactcttaatcatctttcatttcaatcataattactgggttccttactttttcagtttctatatcataacaaaaatttccatcatctgtgttagaaacaagctgtgtgtctggtttgttatcatttttatagtctgatttattttaatttaaatgaagcttagaagatgactggtaagtgtatttcagggacctggagtgtgaatggaataaaaagatatttgacatgggcttcctctgttcaggcgctgcctggactgccacagagctagaccctccagatac

SEQ ID NO: 73082 - DNA, 458 bp, Homo sapiens
ggcggggcggagaagcggctaaaataagcagccagggattaggaaaaggaaggaactgtttgctgggatcagttaagtctgctccttgtctgcccataaattctgtaccgtgagaaacattttcacttttcaaagagaagtgccccacttgaacataactaccaagaatcaaaggctgggagtgctttccctcccttccatccattttctctgtatttactttattatctcatgtgtgtggcggggagggggggaggctataggattcttataatggccctttgggcatcagcacctgctatgaagaacaaggctcttaggtctttcaaagagagaggctaggagagtaaggagaagaagggaagctactactgtcccaattctgttctaaattgtctgagaaaattagcatgtctatgttaaagcaatactattaaaaatgaatttttaaccattca

SEQ ID NO: 73083 - DNA, 503 bp, Homo sapiens
aggtagagaaagcagggctcagaactgtgtagtaatttcccaaagttcacagctttgtaggctggcagatagtgctaagcactggtctgcatgctgggacagggagaagcagcagttgttgtagtcatagtaacagtgatgatagcagtagctaccaggcagtgagtcctccatgtgtgaggacccttcctatatgtcatatggtttaatccctgtgacagccctgcaaaggccatgatcctcattttacagaacaggaagcagcctctaagagattaattatttgtccagtcacacagcttttcagcaaagagctgatattcaacccaattccatctgatcctaactttctgctctaaagtcaacttgttcgtcaggattagcgatagttccctgatcacaagaacaaagtctgaggcatggtagaagtaatcttttttttcctaatgttgaatatacagctgcctcctgacattcctattgagccagaatacagaatgttt

SEQ ID NO: 73084 - DNA, 387 bp, Homo sapiens
tatctataaaacaattgtttaaaaatattgaggttagctcttcccctttgctaatgcaataagcacattatttgcaaagggaagcattaattatactactattgtatgcagtattaaatgaattgtcaatgtcacgatcaaaataaacccttgaagaactggctgttgttcccataccttcatgagaattgtaaacactcatgtaaaatagaaaccattatttaccactttgcagtgaaatggatcatgtgttctgacacctgtaccctgagttgagtgggaaacagggactgtttgatgaattaaaggtaactttattcctgtataccactaggggtgcaagtgaggggactgtagacaattagtactttagatatttgttggagt

SEQ ID NO: 73085 - DNA, 547 bp, Homo sapiens
ggccgggctgtttagcagctggtctcactgcttaggttcctacagcctagctgttacagcgtccttgctacagaaagagatcgttgtctgaccagagacaaaacttacttctgtctggtagcagagtacctacatttggctttccagatctcacctcagttccagattcctctacattaaaatcttcgcctgggttacatcttctctcaggattgaatatcaacactattgaagacacctcatgtgacatcacaaacagctttcttggactctccaggtactccaatttggactgtatcttggtactttagacttgtgaatttgaattcaactgtctgagtgagactccaagatgggaacaggatttgtggttcaactgtgttatcctactctggaagaaatttatgaagttattgatggatcgcccccactaaattgttatcaaaaatttccaaatccttattttttaagtctgtttttgacattatttaatcatcaagggaagacttttaagtgttatgcattaataaaggacattgtgaaatat

SEQ ID NO: 73086 - DNA, 659 bp, Homo sapiens
ggccgggctgtttagcagctggtctcactgcttaggttcctacagcctagctgttacagcgtccttgctacagaaagagatcgttgtctgaccagagacaaaacttacttctgtctggtagcagagtacctacatttggctttccagatctcacctcagttccagattcctctacattaaaatcttcgcctgggttacatcttctctcaggattgaatatcaacactattgaagacacctcatgtgacatcacaaacagctttcttggactctccagggaggtggagcaagatggctgaatagaagcctccagcaattgtcccccactcacaggaacaccaaattgaacaactatccacacacaaaaaaaagcaccttcatacaaagaaaaatcaggcctggaacagatcagcctccctgcaggaatcaactgagaaagaattaatgacactttcgaaagctttaaattccaatgagaaattgaagccctgggaatatctgcctcaacattttatagggtgtatgcctgcagtcagtgagaagcacgaggatattccgttccttgtaagtgtaaagtatgataaaacattaatcttaaatctcttacatagtaacaaaacaagacctacactaaaatatttggcattctgtggcacagc

SEQ ID NO: 73087 - DNA, 246 bp, Homo sapiens
tgattctggtactttgggaggctgagtggggaggattgcttgagcccaggagttgaggaccagcctgagcaacatagcaagaccccatctctacaaaaaatttttggaagtagccaggcgcagtggcatgtgcctgaagtcccagctactcaggaggctgaggcaggcgaactgcttgcacccagaagctgaaagctgcagtgggctgtgatcacacaactgcaccatagcctgtgtgacagaatg

SEQ ID NO: 73088 - DNA, 436 bp, Homo sapiens
  misc_feature (292)..(292): n is a, c, g, or t
atctttgaattgctgttatcccatataggcctatgagagagttgccagacttaaataattatttatatgcttaatttcttttaacacatagaataattctttaaaaaattgttttctctgtaaactgtaactgaaacccatgctgccctggaaagcaatgttacaaactgctgtaccctctgcctgaagacaagtttttatttctttatcctaatacccaacaacaattagtatcactttaaaagataaaatagaggccaccgcacctggcctcctatctctcttataagtngacttttcttcttgcttctttgaaacagaaactttttgtaaataaataaagtgtataaaggtgagccatattgggaagaaggggctgatagaggagttagaacaaccaggtaaccagatttttttttcctattcttttgaggaa

SEQ ID NO: 73089 - DNA, 945 bp, Homo sapiens
tttggtgttttaaaacaaatcacagatatcttaacgttccaaatacatcagtatgcatctgaaaagtaagaaacttttcagatagctaaacaacatcgcaataataaagttagtaatactttcttaatattatctaatagccaacattcaaatttcttcatttttactaaaatattcttcacaattggtaaagaattcactccaggactatatatctggttttaattccttcagtctcttttaatctggaacagtccttttttctttatgacactaacttgctaaagaagagactatagaatagtcatgagtagacttttctggaactaattagaagagacttacttatcatttactgtctttgttgttttcatctttttttttttttaatttaaaaaaacaaaacaaaactgggcacaaggtatcaccatgttacccaggctggtctcgaactcctgggctcaagtgatcctcctgcctcggcctctcaagttttcatctttttaggtcaaaggttgtaatacaatttgacagtaaaatgtatattttattggtagattagcaaagtttataatttgtcttggggacagaattactcaaggattgatttttctttttttttttaatgtcttgaaagattgattcagtgttgctttggccaaaatcaccttacctatatagaaagaaaattcattgggttgcaaaaagaccccaacatgtagcatcacaaataacatgtaatattagatgggttggcctatccctggtgtgtaatgagtaactcgcccctccataggagcagttgccaactttagcatctgctgccttgccagaggctgtgagggctttggccctgccacagtgcggccatttatcaccatagccgagaaggacatttgcagctggcttagattaatggctctcccaacgtccttccccaccctg

SEQ ID NO: 73090 - DNA, 1964 bp, Homo sapiens
cggaagcacactgcaacatgccaaaaaacaaacttctaggtctctttaatacaggaagctgaatagatccagaggggtaagagcaggtttgaaaatttacattttggtgtgttctttgattttatttatttatttttctggattaagctaacatatttctgttttcagagcccaaatcaaaagttggttttttggcatgttgcatgtgggttgggaaagaaatttgtccgtgtcggaacccagttataccgatggttcttcatatgtttaaaactttttttttcttttatcattggatttgtggaagtggaaagttgcagggagctttgcagtgtaaatggtattgtttttcccccagagagtttgaacggcccgtatcggtttcagccctgctgttcctgggtggatccctcttacttttccaggtgcggtgggtgggagcctcattctcctgctagatgtagtctcccttctttggcttataaaagaaaacaaatggaaccatgttaactgaattgccatctccttcttccttctaaactacctttgatagcaaagatttgtggaggtgtttgttaaatctgcaaatacgataacgtttggtttatgtgtttaaagggataaggaaattctaatcatgctttttatttcacctgagtaaagtggcaacatacctgaaaatattttcagctttttgcactctgaaagggccaagggtggaataaaattaggtttagaaaaaccatttatacaaagtttagtgtttaaaatacatttcagaaaacaagggagatttttatttttaaaccaacctgaaagttgttttttggagttgaatttattgtttagttaatttaccatgaaatctgaaatctcttagagctgaaggcccatgactgtgctttcatatcttatatttaatcttaagatttgttttgtttttgcaaatacattcttgcaaaagtacggattctagataattatatagccaactcatcagtagctgaaaaactagggtattctcttctctttttgaaaatgtgaatccgcctgaaaattatagatgctgtcctaattgtaacaagatgggctttagtgtgtaagctgctcattagctttaaactggtatggatctttaataatctgatttcgttctcccctcacccccctgccacaaatttttttaagactagacttccttgaatttcttttctagaatgagggtatttcttgaaagacgatttcatccttgtgaagttgtggcttcaggaggaaacagaactttgttcctccttcaaatacaacctaggcaaaggctgcaggaaatttttgatgtctgaatctcataattataacaagtacagttaaaagaaagaaaaaatacaatgtgtataggctgttgaactgtagttcttgtttaatattttccaaattttctttcaaatgttctctctgccttgactccagcctggggaggtttcttggatctttagagtgttggtcatgttgcttccagagtgtctgtttcccactcaacctttagggggagggatgagggaatctgaaggaggagtacaaaggcagtttgaaaataggttctggatgactgagtggtggtgatttgggtctagctttaaatagtgggctttgtgtagctgaagtgagcatcctagttaacctagtgtccaggactatttccacgaactaagggttgttttgactggtgtgtagtacagagcctttggggtgataagatggaagatttgtcttttacctcacctccactggttctttcaggaattataagggatgcagataagtaaatcttttattttttaaattttttgttttgctcattgtcttggttttggggtaaaaaatgatgataggtaagtatgagctgttcagatatttctttccttgtttgcctcctatgtacggttggtttctttgttatgtgagta

SEQ ID NO: 73091 - DNA, 627 bp, Homo sapiens
tctccggggtccgccgaagctgccctgcaggagaccatgggctgcggcggggacttccgggtgtctgagaaagggaagcagaaagactgggaggccagggtcgcatccccctcgcattcagccgacccggctggcccccgcccgaagttgctggagccggagttggaagagggtcatttgcatgtgctaggagctgtcttccctgttcagaatgaaattggttaggacagagaaccgtgtctgagctaaccaagtggaacagaattccctatggtcaaattaagtgatctctttatttcgccatcctgattgaataatcttatcattttaaatagagaaggtctccaaggaatgtaaataatatgaatgcccacggatttgtatttactgagcgtctccttctccttctcttggcatataaaacacagcaaggagcggcaaggttagctcaaatgttaacgctatcaattttcttctgttaaatgccctgggggaggaaaaaagaaaagaaagaaagaaaaggaagagaaaaaaataaaatggaattgtgtgtatgtgtttgtttgtggggaggaatcgtagaccccagtcacataacagaaattttctccgagttgcctgattttc

SEQ ID NO: 73092 - DNA, 99 bp, Homo sapiens
ctccttggttgggatggatttattcaggagcagtttttgagcaacttgccatgggcaagaagaagatcgccaagagatcaagataaaatctttgtgaaa

SEQ ID NO: 73093 - DNA, 270 bp, Homo sapiens
attttgctttgtttttttaagaagactcttctggcactttccttggctgtgataaagagttttgatatcccctaatgccagtgggtttctgggaacttgaatgagataatatatcggcagtgcctagcacagtgcctggcatctactcataggatgcacccaataaatgctagttactgttcttgtatgaagtgtaaataaaatactttattagtgttttacaaaagagattgtaaatagagaagagcagaaggccatagcctgagacca

SEQ ID NO: 73094 - DNA, 526 bp, Homo sapiens
ggtctgaatgtgaatgttgcactttgagaggaaatagtatagaagtagttacattgctgggtgactgatctagcaagtccctaacagtgccattaagctgtcctgtagtacatcttatttagttctctcaataactacatagtatgttgtcagtcctattttatagatgagaaaaccaagggaacaatttgatagaataatgtttccaaaatcagagatctaatcttagaaggcttagttgaataacattggatatattactctgcggttcctaagtctatgaattaatgggaattttgaaatctaattgaaatccaaggagaaagtgatagaaataaaattgtagtgagcgatgtcggctcactgcaacctccacctcccaggtttaagcgattctcctgccttggccttccgagcagctaggattacaggcatgcaccaccacgcccagctaatttttatatttttatagagacggggttttaccatgttggccaggctgatctcgaactcctgacctgaagtg

SEQ ID NO: 73095 - DNA, 467 bp, Homo sapiens
gaactgcccttctcctgtgctgggccatgaccacggagaacaggtccactgtcttccctgcgtggtacacaggggaggctcagactccatcctcaaggatgacaagaagacaggccaagacatgagcctcaggatacaggtgatgggtgtggagcccacaggactgcagcctcacactgcagggctggaggcacagactgagtatttactattctatggcctggggggctcaaggcatagagctccttattagccgaagtcgcccaagttccccaacctctaaagatttcctcataatcatgcaagaagaagaagggaaaagtgagtgtccatagaagttttggggctcttcctctaatcaggagagagcttgtgtaaaattcttcgcctctttcttttctttttcaagatccaagtgctttaattttcatattttattatgggaaaatataccacgtataaatcct

SEQ ID NO: 73096 - DNA, 398 bp, Homo sapiens
gtggtgcatcacattgaggttctaatcttgaactagctttgcattcctggaataaattacacttatctgtgttgtaaaattctttttatatgttgctgaattttattcactaatattttgttaagaatgtttacatttggccgggtgcggtggctcacgcctgtaatcccagcactttgggaggctgagatgggtggatcacctgaggtcgggagtttgagacccacctgaccaacactgagaaaccccgtctctactaaaaatacaaaattagccaggtgtggtggcgcatgcctgtaatcctagctacttgggaagctgaggcaggagaattgcttgaacctgggaggtggaggttgcggtgagcccaggtggcgccattgcactccagcttgggc

SEQ ID NO: 73097 - DNA, 423 bp, Homo sapiens
cttcatactagaactgtctgccatctttatttctttgttttcaggaaaattggagagaaaagtatttcttttttaaaaatgattattatactttaagttctgggatacatgtgcagaacgtgcacgtttgttacataagtatacacgtgccatggtggtttgctgcacccatcaacccgtcatctacattaggtatttctcctaatgctatccctcccctagccccccaccctccaacaggctccagtgtgtgatgttcccctccctgtgtccatgtgttctcattgttcaactcccacttatgagtgaggacatgcagtgtttgattttctgttcctgtgttactttgccgagaatgatggcttccagattcatccatgtccttgcaaaggacatgaactcatcctttttatggctgcatag

SEQ ID NO: 73098 - DNA, 447 bp, Homo sapiens
gcctcacagctgcagcctggccgacattccacagaatacaggatgccttccagttccagagatgttagaagataaacaagtgtgtttaggagttgatggaattgatcccatcaacgttcattcattcattaattcattcttgcagtagaatgaaaactatgtacacttaaatatttttacttattttcaccaaagttatatatatatgtgcacagttaaagcaatagtttctcattaccgattaaaagcaaaacagcagttctctgccatagccgttccttcttcccagttttgaactccccataaccactttcaactgtgaactctttctttctggcttttaattccctttttttttttttttttgagacagaatttccctcttgttgcccaggctggagtgcaatggcacgatctcggctcaccacaacctctgcctcccaggtt

SEQ ID NO: 73099 - DNA, 620 bp, Homo sapiens
  misc_feature (491)..(491): n is a, c, g, or t
ggcaggtgctcgcttggtctagtgcccatttactctggactccggatggctgccgcacgcctctgcctctccctgctgctcctgtccacctgcgtggctctgttactacagccactgctgggtgcccagggagccccactggagccagtgtacccaggggacaatgccacaccagagcagatggcccagtatgcagctgatctccgtagatacatcaacatgctgaccaggcctaggtatgggaaaagacacaaagaggacacgctggccttctcggagtgggggtccccgcatgctgctgtccccagggagctcagcccgctggacttataatgccaccttctgtctcctacgactccatgagcagcgccagcccagctctcccctctgcacccttggctctggccaaagcttgctccctgctcccacacaggctcaataaagcaagtcaaagccaaaaaaaaaaaaaaacaaaaacaaaaaacaacaanaaacaaaaaaacacaaaaacagaaacaaaaaagggggggcgccacacaaaaatcccccaggggccacaggcgcgcaggcgccagcggatatggttgcgccacggggcgccacaacggggcgcgaatcac

SEQ ID NO: 73100 - DNA, 909 bp, Homo sapiens
ggcaggtgctcgcttggtctagtgcccatttactctggactccggatggctgccgcacgcctctgcctctccctgctgctcctgtccacctgcgtggctctgttactacagccactgctgggtgcccagggagccccactggagccagtgtacccaggggacaatgccacaccagagcagatggcccagtatgcagctgatctccgtagatacatcaacatgctgaccaggcctaggcctagaccaatgtgccctgggcaagatggtgcctacaggcagatatgaaacaggtgggctggcacctgggcacagtgcttgcccctgctgcctcttccctcccaggtatgggaaaagacacaaagaggacacgctggccttctcggagtgggggtccccgcatgctgctgtccccagggagctcagcccgctggacttataatgccaccttctgtctcctacgactccatgagcagcgccagcccagctctcccctctgcacccttggctctggccaaagcttgctccctgctcccacacaggctcaataaagcaagtcaaagccaaaaaaaaatgtgaacagcaacgtaagaaccggagggagaagggaacgtctcagagggactcctggggtctaagtagcaccaaaggaactacaaggaggggcccgcacggccagaaaaataattcccatccgggaggggcgccaagaatatagttaccacacagctcccagatttggaaggggacaacaagcctcccaccagaggggagacgtgaaacaacggccgggagggcgtgggtccccaataaaacaccacgaagacacgcagggacatgcacggtgcacgccaaaggacaggaaaaagccaccaacgtgcgcggggggcaggacggcaggacacaatcacg

SEQ ID NO: 73101 - DNA, 620 bp, Homo sapiens
  misc_feature (37)..(37): n is a, c, g, or t
  misc_feature (491)..(491): n is a, c, g, or t
cgggggccgctcggcagcgggttggtttttcccaganccttcggttagactagcgctcttcctggcctctccctgctgctcctgtccacctgcgtggctctgttactacagccactgctgggtgcccagggagccccactggagccagtgtacccaggggacaatgccacaccagagcagatggcccagtatgcagctgatctccgtagatacatcaacatgctgaccaggcctaggtatgggaaaagacacaaagaggacacgctggccttctcggagtgggggtccccgcatgctgctgtccccagggagctcagcccgctggacttataatgccaccttctgtctcctacgactccatgagcagcgccagcccagctctcccctctgcacccttggctctggccaaagcttgctccctgctcccacacaggctcaataaagcaagtcaaagccaaaaaaaaaaaaaaacaaaaacaaaaaacaacaanaaacaaaaaaacacaaaaacagaaacaaaaaagggggggcgccacacaaaaatcccccaggggccacaggcgcgcaggcgccagcggatatggttgcgccacggggcgccacaacggggcgcgaatcac

SEQ ID NO: 73102 - DNA, 650 bp, Homo sapiens
  misc_feature (521)..(521): n is a, c, g, or t
ggcaggtgctcgcttggtctagtgcccatttactctggactccggatggctgccgcacgcctctgcctctccctgctgctcctgtccacctgcgtggctctgttactacagccactgctgggtgcccagggagccccactggagccagtgtacccaggggacaatgccacaccagagcagatggcccagtatgcagctgatctccgtagatacatcaacatgctgaccaggcctagtgcttgcccctgctgcctcttccctcccaggtatgggaaaagacacaaagaggacacgctggccttctcggagtgggggtccccgcatgctgctgtccccagggagctcagcccgctggacttataatgccaccttctgtctcctacgactccatgagcagcgccagcccagctctcccctctgcacccttggctctggccaaagcttgctccctgctcccacacaggctcaataaagcaagtcaaagccaaaaaaaaaaaaaaacaaaaacaaaaaacaacaanaaacaaaaaaacacaaaaacagaaacaaaaaagggggggcgccacacaaaaatcccccaggggccacaggcgcgcaggcgccagcggatatggttgcgccacggggcgccacaacggggcgcgaatcac

SEQ ID NO: 73103 - DNA, 575 bp, Homo sapiens
tcttgtgaaggtgagcccaaaagggtaggttagatcagacaaaaaagtattttttaatgttttgcttagaactttaaacttgaagaaacagtggagccctttgtaaaggttttaaaactagagctttatttcaagaaaatagctagtgataattgtgaaggctaggcttttgaggataggtgattgactataggactgttacagtgatcctgtgctgtaaggaagaacttaatgaaggccgaggcattagaaataaaagaaaggcatcaaactcaagtagtgttacagagttaaaatcagtttgtaagacttggcttaggatgggaaggaaaatggttgaatgttgtggctgtctgggaggatgagtagtgccacttaacgaagatagaaataggttcgatttataaaacaaaggaaatatttagaaaatttgtcaaaatataaggaaaaaagtaagttactatccactatttgtgtatctcatcaggtgtgttcagtttatttattgtagcaaaatatacataaataaaatttaccatttaaacaattttaaattgtacagtttagtggtagta

SEQ ID NO: 73104 - DNA, 246 bp, Homo sapiens
cccaaacaataaaaggttcagcctggctcctaattaggccaaatgaatggttatggtcttgagtctctacagacttgtgctgcccatttgcagatgaaacctccctgttgaatgagcagtgctgctctttaagggcacacgcattgctaaaaggcgcatctcatttgcaataatcaacaactggaaaggccctaattgtccagcaacaggaaaagggtagaaggtagatgttctaggaccactagt

SEQ ID NO: 73105 - DNA, 481 bp, Homo sapiens
tgagaacggagccaaaccagggtgttcaatcgcagaggttaaagtgattctttcactgagataatctaaatctagatcatattgaatctgccttctctctggcacggaaacattttccaaggtattcacgttggaagtatgaattacccacactctctttaaagccccatccaattaaaagtagatgaaaatctccttaatgcagagtcctttagaacatgccaggggtagcagggagggatgagagatatatatttataggaaatctgatagaagataccaccatgcaacctgagggtgagtctgagaagatatttactcatgacttgtatttcttttaaaaacaattacttttgatatgtatctaaagtatcttctctgtcatttaggataaaaacagattaggcttttactcaggaatgaattagaagccctggcattctaggcagctacagagtttgtatccgcttgcagaaaattt

SEQ ID NO: 73106 - DNA, 142 bp, Homo sapiens
acctaagagtacatcactattctgctcaaaacttttaatgggttcctactgtgcttagaaaaaaactcgagtcctcacaaagccagcctaccgggcccctcctaacccgactcctctatactcatacctcatctcccccatt

SEQ ID NO: 73107 - DNA, 677 bp, Homo sapiens
agatccccttatccaggccacctttggaaaccagcccacctgctacaccaaccttttcccaacaccgtggtcccacccctaccttcgctgctgaaaaaccgcattgtgtgggggtctggaatcttctggactcctgggaccccaatccgcttgcctcttgtacccctcttgcagagcaatgagccgatggggtgccaggcattagaaaccttccctccaatcctcaccatgtctccattttgccaaagaagaaactgaggttaaggtcgcgatgctctggccagcatcacaggtaaacgattttggcagtgcccggagaaagatagaagggcctctctctgagatcgggtcctcctcctgcagggcagcagagtggaagccagggcctgggaccctctggctgggcaaggagggactggagtccggctcccggtgaccccgtccccagtgccagcggtggggtcgcctgtggcggcccggacaggccacgggtccctctccccaagtcccattacgttgtatttatgtttcattttatagtttttttttcctcctcccttattattgtttcactctgggggaggcaaaggatataatatattcatctttattataccaaatctgtgtgaagcatttaataaaacgctgtttccacacagccagggataaaaaaaaaa

SEQ ID NO: 73108 - DNA, 606 bp, Homo sapiens
agatccccttatccaggccacctttggaaaccagcccacctgctacaccaaccttttcccaacaccgtggtcccacccctaccttcgctgctgaaaaaccgcattgtgtgggggtctggaatcttctggactcctgggaccccaatccgcttgcctcttgtacccctcttgcagagcaatgagccgatggggtgccaggcattagaaaccttccctccaatcctcaccatgtctccattttgccaaagaagaaactgaggttaaggtcgcgatgctctggccagcatcacaggttcctgtgcgcccaaacttgtgccgggcaccaagacgagaataagacagcagggcagaagttgtggagaagctgaattgtctctctgcaaggaaaaatttcctgacacaagtatctgtccagagaggaagattcaactgcaagagctttcagcaggcaatggtgtccaactagaatcgaaacacattgttattgttttacttatttttataattactttttattttggcaagtaacgggtggtttcgcagttactgtagtgctagaaggcttttttaaaaaaacaataaacatacttgagtaagaaatagtaa

SEQ ID NO: 73109 - DNA, 930 bp, Homo sapiens
agatccccttatccaggccacctttggaaaccagcccacctgctacaccaaccttttcccaacaccgtggtcccacccctaccttcgctgctgaaaaaccgcattgtgtgggggtctggaatcttctggactcctgggaccccaatccgcttgcctcttgtacccctcttgcagagcaatgagccgatggggtgccaggcattagaaaccttccctccaatcctcaccatgtctccattttgccaaagaagaaactgaggttaaggtcgcgatgctctggccagcatcacaggtaaacgattttggcagtgcccggagaaagatagaagtaagacctaaagaggaactttccgcatgttatgggagagcccctggggcgaggaggcgagggcagccttccccaggccaagggagcagccatcgctcttggatctgtttttcctcaagcgtctgtcctgtggggcctagtccccaagcggcagtcctggacctaacgggagaaggggctgggggaagagggcgcacccccagcccgggacccacagcagccctagccagtcccccactctctccctctgtaggggcctctctctgagatcgggtcctcctcctgcagggcagcagagtggaagccagggcctgggaccctctggctgggcaaggagggactggagtccggctcccggtgaccccgtccccagtgccagcggtggggtcgcctgtggcggcccggacaggccacgggtccctctccccaagtcccattacgttgtatttatgtttcattttatagtttttttttcctcctcccttattattgtttcactctgggggaggcaaaggatataatatattcatctttattataccaaatctgtgtgaagcatttaataaaacgctgtttccacacagccagggataaaaaaaaaa

SEQ ID NO: 73110 - DNA, 884 bp, Homo sapiens
attttagtgaattttcagaaattatagtggaatggatgctcatatattgcttatggatattttggataccaaagtaggaataactgacattcagtattttaaagctggcaaacctgtacatagaaaatagatccccagacagtggtctatgaagagggcagttaagtatcaaatacttaattttcttgcctttttttcttaagtggggaaaagtttctagatctcttacacctctgacacaatctgttctaaaacaggcacttgtaatgttggggcctccttgtaaacgtgtttttgccctttactctctgggagttctttaaaggtgaaatcatcttacaaagaaattgggggagggtcttggcaaaggactttcccctcctctttcctggcctgggaaccttatactgacaatcaatactttatattttaaagtatataatttatagttaacttctagtgtaatatattaggaaacactagaatggaaaggccattggaagacaggttgtatcttttttagaccatatttccttgtttaaaaactatcatttgaatacttttttggtgaagaactccatgttttcaagttaaaggtcacctcgtaggccaggcgcagtggctcatgcctgtaatcccagcactctgggaggctgaggcgggtgaatcacaaggttaggagtttgagaccagcctggccaatatggtgaaaccccgtccctactaaaaatacaaaatttagccaggcgtggtggcatgcacctgtagtcccacctactcgggaggctgaggcaggagaatcacttgaacctgagagacagaggttgcagtgagccgagatcacgccactgcactccagcctgggggacagagtgagattctgt

SEQ ID NO: 73111 - DNA, 536 bp, Homo sapiens
atttattcaaattatagaatattatacagcactgaaaaataagcaaattgtagccagatggtgtaacttaagtcaatctcagaaatatgttagattaaaaaaaagcaatatgcagacaaacataaagtatgacactgtataaattcaaacgcaaaaaagctcaacaatatggtttaggaatatgcacatacatttgtggacaaagctattatggaaagcaaaggaattgaaacaccaaaataaaataagtcgtcgtttttggaagggtggcaggagaagaggatgtaatgaggaaagggctcaaaggacttcaaagataatgttccattttgtaggctgggtggtggccacatggatgtttactttcttcttttttattttttttcttttagacaggatcttgctctgttgtccaggctgaggtgcagtggtacaatcatagctcactgcagtctcaacctcctgggctcaagcagtcctcctgccttgacctcccagagtgctgggattacaagcgtgagccaccttgcctagtc

SEQ ID NO: 73112 - DNA, 596 bp, Homo sapiens
cggcacgagcgcgcgtccaccggctccccggctcgcgccgctccatgtagccccggctccccgggcggccgcggaggagggggcgaccacaagatggcggacctctcgctgcttcaggaggacctgcaggaggacgcagacggatttggtgtggatgactacagctcagagtctgatgtgattattataccttcagccctggactttgtctcacaagatgaaatgttgacgcccctggggagattggacaagtatgctgcaagtgagaacatatttaacaggtatgtgcatattctttttgttaaagtggaagtggaagggtggttttattaacttcagtagggaaaatgaaagtatccactttaaaggaggtattattaacaggcacaatctgagtcaccaagttttattcataatcacagcatgagcagttttgtacttgtttattctttgatcctagtaagcatacaacatgctttctttgcaaaaaaaaaaattaccattaattaccattgcttttctgccactggacataattttggtattcatataaattgcttattgggaagtacattattccttcaacacatgatgtt

SEQ ID NO: 73113 - DNA, 3840 bp, Homo sapiens
cggcacgagcgcgcgtccaccggctccccggctcgcgccgctccatgtagccccggctccccgggcggccgcggaggagggggcgaccacaagatggcggacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatctatagagagagatatatacacttttgattgttttctagatgtctaccaataaatgcaatttgtgacctgta

SEQ ID NO: 73114 - DNA, 3891 bp, Homo sapiens
cggcacgagcgcgcgtccaccggctccccggctcgcgccgctccatgtagccccggctccccgggcggccgcggaggagggggcgaccacaagatggcggacctctcgctgcttcaggaggacctgcaggaggacgcagacggatttggtgtggatgactacagctcagagtctgatgtgattattataccttcagccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatctatagagagagatatatacacttttgattgttttctagatgtctaccaataaatgcaatttgtgacctgta

SEQ ID NO: 73115 - DNA, 738 bp, Homo sapiens
gattagcatggcccctgcgcaaggatgacacgcaaattcgtgaagcgttccatatttttaatgagctaccaaattgtaaaataaatcaagaagattctgtgcctttaatcagcgatgctgttgagaggtgctttgtttctgatcggaccatttcactgcagcaagcaacacagtattctgagcagaagatcgggacttgaggccatgttgcggagggccagtgacattatctggactctggagtgtgaggaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttctcatattgccacagagagatatctttatcacttccagagc

SEQ ID NO: 73116 - DNA, 569 bp, Homo sapiens
tactgccgtttgccacttaggaaattatagacctaatatatgttttaataatgtaataagaaaaaattttcttaaaaaatatacagattttgtcttttaaaattctagatatcggccaggtgcagtgactcatgcctgtaatcccagcactttgggaggccaaggcaggtggattgcttgagcccgggagtttgagaccagcctgggcaacatggtgaaacagcatctctactaaagatatttaaaaattagccaggtgtggtggtgcatgcctgtagtctcagctactcaggaggctgaggtgggaggattacctgagccagggaagtcaatgctgcagttagccgtgatcacaccattacactccggcctgggcaacaggaatgaggccctgtctcaaaaaattaaaattctggatattagctattgatgccattgaacatacataattttgttttttttgtgtagacaaatggtggcccggagtttgctcgatactctttaaggatagatttgtgttttcctttacctgtttaccagctccagagttttttttttttttgtaagtg

SEQ ID NO: 73117 - DNA, 545 bp, Homo sapiens
cggcacgagcgcgcgtccaccggctccccggctcgcgccgctccatgtagccccggctccccgggcggccgcggaggagggggcgaccacaagatggcggacctctcgctgcttcaggaggacctgcaggaggacgcagacggatccctggactttgtctcacaagatgaaatgttgacgcccctggggagattggacaagtatgctgcaagtgagaacatatttaacaggtatgtgcatattctttttgttaaagtggaagtggaagggtggttttattaacttcagtagggaaaatgaaagtatccactttaaaggaggtattattaacaggcacaatctgagtcaccaagttttattcataatcacagcatgagcagttttgtacttgtttattctttgatcctagtaagcatacaacatgctttctttgcaaaaaaaaaaattaccattaattaccattgcttttctgccactggacataattttggtattcatataaattgcttattgggaagtacattattccttcaacacatgatgtt

SEQ ID NO: 73118 - DNA, 472 bp, Homo sapiens
ggtggcccctctctcccagctagccaagcccctccttacactggcatgcaccacacacaccccacgtgcctgctgtatgtgcttgttccacaccacatgcctggtatgtgcgtgttctgctctgcacacattcagacgtgtgtatatgtacatttcacagtgcacatacatgcatgttcctcactgttcctcactgcatattacacaggcatacatacatgtaccccaccacacacatactgtgcacacatataccataccacggttcccactagagggtgctcatgtctgggacccagagcgcaggtgtgaaaatgaaacacctgtgaatgaacactctaggtctccgtagagcagtttaaaaactgtgtctgtccgtgtgggcagttaattatgtaatttttgatttgagttcccaagtacgtggaattttggttaaaaagcaataactaaaatttgtacctgtggtcac

SEQ ID NO: 73119 - DNA, 3890 bp, Homo sapiens
cggcacgagcgcgcgtccaccggctccccggctcgcgccgctccatgtagccccggctccccgggcggccgcggaggagggggcgaccacaagatggcggacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatctatagagagagatatatacacttttgattgttttctagatgtctaccaataaatgcaatttgtgacctgtattaatgatttaaagtggggaaactagattaaaatatttgtcttttaacta

SEQ ID NO: 73120 - DNA, 3891 bp, Homo sapiens
cgcccggccgggttccggcactcgccgcagggtcccggccggcggcaggttgcgcgcccccgtccgcagcgctcggcgtgagggcggctcgggaggagggtacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatctatagagagagatatatacacttttgattgttttctagatgtctaccaataaatgcaatttgtgacctgtattaatgatttaaagtggggaaactagattaaaatatttgtcttttaacta

SEQ ID NO: 73121 - DNA, 3941 bp, Homo sapiens
cggcacgagcgcgcgtccaccggctccccggctcgcgccgctccatgtagccccggctccccgggcggccgcggaggagggggcgaccacaagatggcggacctctcgctgcttcaggaggacctgcaggaggacgcagacggatttggtgtggatgactacagctcagagtctgatgtgattattataccttcagccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatctatagagagagatatatacacttttgattgttttctagatgtctaccaataaatgcaatttgtgacctgtattaatgatttaaagtggggaaactagattaaaatatttgtcttttaacta

SEQ ID NO: 73122 - DNA, 3731 bp, Homo sapiens
cggcacgagcgcgcgtccaccggctccccggctcgcgccgctccatgtagccccggctccccgggcggccgcggaggagggggcgaccacaagatggcggacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatctatagagagagatatatacacttttgattgttttctagatgtctaccaataaatgcaatttgtgacctgtattaatgatttaaagtggggaaactagattaaaatatttgtcttttaacta

SEQ ID NO: 73123 - DNA, 3771 bp, Homo sapiens
cggcacgagcgcgcgtccaccggctccccggctcgcgccgctccatgtagccccggctccccgggcggccgcggaggagggggcgaccacaagatggcggacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatcta

SEQ ID NO: 73124 - DNA, 4015 bp, Homo sapiens
cggcacgagcgcgcgtccaccggctccccggctcgcgccgctccatgtagccccggctccccgggcggccgcggaggagggggcgaccacaagatggcggacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaggtgctttgtttctgatcggaccatttcactgcagcaagcaacacagtattctgagcagaagatcgggacttgaggccatgttgcggagggccagtgacattatctggactctggagtgtgaggaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatctatagagagagatatatacacttttgattgttttctagatgtctaccaataaatgcaatttgtgacctgtattaatgatttaaagtggggaaactagattaaaatatttgtcttttaacta

SEQ ID NO: 73125 - DNA, 3961 bp, Homo sapiens
cggcacgagcgcgcgtccaccggctccccggctcgcgccgctccatgtagccccggctccccgggcggccgcggaggagggggcgaccacaagatggcggacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaggtgctttgtttctgatcggaccatttcactgcagcaagcaacacagtattctgagcagaagatcgggacttgaggccatgttgcggagggccagtgacattatctggactctggagtgtgaggaatatggactccactcttcactatattcacagcgattcagacttgagcaacaatagcagttttagccctgatgaggtatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatctatagagagagatatatacacttttgattgttttctagatgtctaccaataaatgcaatttgtgacctgtattaatgatttaaagtggggaaactagattaaaatatttgtcttttaacta

SEQ ID NO: 73126 - DNA, 2529 bp, Homo sapiens
tcttttcatactaacgcagaataatgtacagtagcagataaacatttttaatctcatgaaagcatattagttttctactttttctcttgaaggactaatgatttaccacagtagaaatttttttccagctttttgattgcagtgtcaaaaaagtatatatttcattgataacgtacagtgcaaatggagaacagccttgtaagaatattgcaattgtgtttctcactttgtccatttccttattttgcctgtagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatctatagagagagatatatacacttttgattgttttctagatgtctaccaataaatgcaatttgtgacctgtattaatgatttaaagtggggaaactagattaaaatatttgtcttttaacta

SEQ ID NO: 73127 - DNA, 4181 bp, Homo sapiens
cggcacgagcgcgcgtccaccggctccccggctcgcgccgctccatgtagccccggctccccgggcggccgcggaggagggggcgaccacaagatggcggacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatctatagagagagatatatacacttttgattgttttctagatgtctaccaataaatgcaatttgtgacctgtattaatgatttaaagtggggaaactagattaaaatatttgtcttttaactagtttattagtttctctggaatctgcctgtgtccctgggtttgggttttgctcttggcagcagcaggtgcctcttgggtgctcctcctgctcctgcctgcagccctaagagcaggtgggtgccgagtgtctggcacagcttggatgccgcccactgaagacagcagaggggggttgtcttgaagctcccgagacacagtcaagcatctctgagcctcgatgtcttcgtcagtaaaatgggaattagtaaaacctgccctgtttctcacagggttgttttgcaggcaaatgag

SEQ ID NO: 73128 - DNA, 3862 bp, Homo sapiens
cggcacgagcgcgcgtccaccggctccccggctcgcgccgctccatgtagccccggctccccgggcggccgcggaggagggggcgaccacaagatggcggacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtatgtattgaacttttaaaattttagatcagcaaactctaagatcctagaatggaagctgttcctcatttctccatgctcaccctcccaggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatcta

SEQ ID NO: 73129 - DNA, 3749 bp, Homo sapiens
cggcacgagcgcgcgtccaccggctccccggctcgcgccgctccatgtagccccggctccccgggcggccgcggaggagggggcgaccacaagatggcggacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatcta

SEQ ID NO: 73130 - DNA, 4061 bp, Homo sapiens
  misc_feature (3772)..(3772): n is a, c, g, or t
  misc_feature (3775)..(3776): n is a, c, g, or t
  misc_feature (3779)..(3779): n is a, c, g, or t
cggcacgagcgcgcgtccaccggctccccggctcgcgccgctccatgtagccccggctccccgggcggccgcggaggagggggcgaccacaagatggcggacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatctanaannaanaaaaaaaaaaaagaaaaacaagcaaacaaccagcccacagtaccgagaaacacaagaggcacaacacacaagaccaagaacacaaaggagggcgggcgccacaaagtagacaccaagcaggaggcgacaagaacacaggaccacagagtgtacaaaaaagaggccctacatagcgacagaaatacacgagagcagacgggcccgagatcacacgcagacggcgaaaagcagagtggggcctgagaagacacatcccgcgggagatcacagaccaccaccgcg

SEQ ID NO: 73131 - DNA, 1227 bp, Homo sapiens
ggtctaagctacgaggccgcggtgaaatcggccgagggtctgcagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatcta

SEQ ID NO: 73132 - DNA, 1160 bp, Homo sapiens
tcttaagcactggggaggactctaagacactggggcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatcta

SEQ ID NO: 73133 - DNA, 1213 bp, Homo sapiens
tctggcactttttcttcctataacaaatcagtttggattactgtttatgtttcagtgtggcttgtttgtacttgtagaaatacccagtttaactgtttacactcgtacttgacggaactctgaagtgttccgttggactggtttcatctgtcctatgcacatgtcatttccagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatcta

SEQ ID NO: 73134 - DNA, 648 bp, Homo sapiens
caggaaacaagctagtgacccatgattagcggaaattccgagcatacggtacccgctcctagcaatggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatcta

SEQ ID NO: 73135 - DNA, 2382 bp, Homo sapiens
cggcacgagcgcgcgtccaccggctccccggctcgcgccgctccatgtagccccggctccccgggcggccgcggaggagggggcgaccacaagatggcggacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagtatatgccactccagcggggatcctcg

SEQ ID NO: 73136 - DNA, 1806 bp, Homo sapiens
cggcacgagcgcgcgtccaccggctccccggctcgcgccgctccatgtagccccggctccccgggcggccgcggaggagggggcgaccacaagatggcggacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagatctagtgctcatcagggattgctatgaggcactgcgccccaggtacctg

SEQ ID NO: 73137 - DNA, 1107 bp, Homo sapiens
cggcacgagcgcgcgtccaccggctccccggctcgcgccgctccatgtagccccggctccccgggcggccgcggaggagggggcgaccacaagatggcggacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagatatgaaaggtcccagagactgaaaagctgcttgatcccaacgaattccggaccagtaccaa

SEQ ID NO: 73138 - DNA, 403 bp, Homo sapiens
gtgaatgaacactctaggtctccgtagagcagtttaaaaactgtgtctgtccgtgtgggcagttaattatgtaatttttgatttgagttcccaagtacgtggaattttggttaaaaagcaataactaaaatttgtacctgtggtcactcagagattttgttagccagtagtcgagtttttggctacattgacagagaagcctagagcagctgtttctcttccccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaaggtaggtagtgactccactagaagaagcgtgtgagt

SEQ ID NO: 73139 - DNA, 630 bp, Homo sapiens
aggaaaaccttggggagtagagatgaatattttagaagaaacagaagtaatatttacactcaagcagattttaatatattttgtgagatagcaaataagtatctttcctactactatcttaaaattgtttttattttattttccttgtgtaatgtaagcaaataggctttaggtctcagctttgcaatatgtcgttggagtagagaggtaatacaaataaccctaaaaataaaataatttaaatgttgttatgtatcttaaaatgattgtaggaatttctgtttccactacttttctttagttatttattattgaaattagcatggtgttatagaatcccaggattcttaaatgttaccttctctaactaatatatattgcttgactatctagacttatacttaacaggtatttacatctttgaacacagaacagctgatggagaaagaagcattataaataatatacataaactcagtttgtacagataatccgtaatttttaatgtttaacttgtctaaatgctatatgtaatatctttcatcagtttttttaaagtaattatcctttcatattgtttttttcccaccaaataaaacaataaaaggaccagagatcaagaagccccag

SEQ ID NO: 73140 - DNA, 422 bp, Homo sapiens
cagatttgtactgcttcagacaggcaaggggtacattttagtttcaaagtgttataaggagtatttctgatgtctctgatagttggtgtggatgactacagctcagagtctgatgtgattattataccttcagccctggactttgtctcacaagatgaaatgttgacgcccctggggagattggacaagtatgctgcaagtgagaacatatttaacaggtatgtgcatattctttttgttaaagtggaagtggaagggtggttttattaacttcagtagggaaaatgaaagtatccactttaaaggaggtattattaacaggcacaatctgagtcaccaagttttattcataatcacagcatgagcagttttgtacttgtttattctttgatcctagtaagcatacaacatgctttctttgc

SEQ ID NO: 73141 - DNA, 1679 bp, Homo sapiens
cggcacgagcgcgcgtccaccggctccccggctcgcgccgctccatgtagccccggctccccgggcggccgcggaggagggggcgaccacaagatggcggacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaaggtatggaagtcaatcaagttatttattctgaaattgattaaaaatattagtgtctatcttaaaa

SEQ ID NO: 73142 - DNA, 1039 bp, Homo sapiens
  misc_feature (1006)..(1006): n is a, c, g, or t
  misc_feature (1009)..(1009): n is a, c, g, or t
cggcacgagcgcgcgtccaccggctccccggctcgcgccgctccatgtagccccggctccccgggcggccgcggaggagggggcgaccacaagatggcggacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttggtcgccaagcagcttttcagtctctgggcctgaagaggcagacctanagnccactctgaatgccaggggggatcctaaga

SEQ ID NO: 73143 - DNA, 2440 bp, Homo sapiens
tccttgtagcggacattttgtttctgtcaggctgtccctggccggggttctgtaacgcttgtgtgggccgcaggtggaggtgttgggaaagcgcggaggagatgttgtccccagtgtcccgagacgcgtctgatgctctgcagggacggaagtgcctgcgtccccgatcgagacgcctgccgctcccggcagctgtccgcgcccacggtcctatggcggagctaacggactccgcgcggggctgtgtggtctttgaggatgtgtttgtatacttctctcgggaagaatgggagcttcttgatgatgctcagagacttttgtaccatgatgtgatgctggagaactttgcacttttagcctcactgggaattgcattttccagatcacgtgcagtcatgaaactagagcgaggagaagagccctgggtgtatgaccaggtggatatgacttcagccacagaaagagaggcccagaggggacttagacctggttgttggcatggagtggaggatgaagaggtatcttctgagcagagcatttttgtagtaggagtgtcagaggtcaggactctcatggcagagctggagtctcacccatgtgacatatgtggcccaatattgaaagataccttacacctggctaaataccatgggggaaaagccaggcagaaaccatacttgtgtggggcatgtggaaagcaattctggttcagtacagactttgaccagcaccagaaccagcccaatggagggaaacttttcccaaggaaggagggcagagactctgtgaaaagctgcagagtccatgtgccagagaagaccctcacatgtgggaaaggtaggagagacttttcagccacatctggccttcttcagcatcaggcctctctcagcagcatgaagccccacaagagcactaagcttgtgagtggctttctcatgggacagaggtatcacaggtgtggtgaatgtgggaaagccttcacccgcaaagacacacttgctcggcatcagagaatccacactggagaaaggccttatgagtgtaacgaatgtgggaaattcttcagccaaagctatgacctctttaaacaccagacagttcacactggagaaaggccatacgagtgcagcgaatgtgggaaattctttagacaaatctccggcctgattgagcacaggcgagttcacacgggtgaaagactctatcagtgtggcaaatgtgggaaattttttagcagtaagtctaatctcattcgacaccaggaagttcacacaggagccaggccttatgtatgcagcgaatgtgggaaagagttcagtcggaaacacacacttgttctgcaccaacgaactcacactggagaaaggccttatgagtgcagtgaatgtgggaaggcctttagccaaagctcccaccttaatgtacactggagaattcacagcagtgattatgagtgtagcagatgtggtaaagctttcagctgcatctccaaactcattcagcaccagaaagttcactctggagaaaagccttatgagtgcagcaagtgcgggaaagccttcactcaaagacccaacctcatcaggcactggaaagtccacactggggaaaggccttatgtgtgtagtgagtgcgggagagaattcatccggaaacagacacttgttctgcaccagagggttcatgctggagaaaagctttaagagtgtagcaaatgtgggggaaagtcttaggccaatgcccccgacttactatatggtggggaactagcagtagttaatgagtgcagcagatgcaggaaagccttcccctggaggctgaaccttacccgccattgggaatttcacaccggacacaggccttagcagtctaagcaatgtgctgtctctgttcagcccaacagctcaccctagagtggaactctgggagcagccattgggagggaaccatcagtaagaagtgaaacttcatagatatggacattcccactggggagattccctgtgagtgccaagtatgtgagatgctttcagcagctgtgttgcactttttaaatggctattggcctttgctggggcaggagccatctgctcctaccatctggcagaatcatactgcgtttaccatttaccccagcatgcttgtgacgggcagacctctcttctctccccagtccctaaaaggtgttgtgagtggtctcacagcccactaggggtcttaatttcctctcttttgatgtaaatggcatggaaataatcagctttgttcaagaggacacagaaggattctgcaaatagcctgcagagacttacctgtgttgattgatttcatatgatgctcgttatggatatatccaatatccaagtcacccagctctggaactgcctgcttcacattgctcatgataataaaggcctgttctttaagccaccaaaaa

SEQ ID NO: 73144 - DNA, 2768 bp, Homo sapiens
catgcccagctaatttttgtattttttttttttttttttttagtagagacggggtttcaccatgttggccaggatagtctcgctctcttgacctcgtgatctgccttcggcaagcactcttaatgctatgtgtagagtgacatttggggagtccagggagatggggtgggccagtagggtgggggggaagctggagatgtgagggagacatagtccagagtgatgtgtatgagaggagggagtgtgagctgacggtcctgtgacttggggcttaactgagaaaaatgagcctaggttcatacctgggatttgtgatcttgggtaccccaggggagttggctggctcagagtgtaaatggcatttatctgtcagcctgtctgttgttgtggtgggctgacacagtgattgctggggtgatcaggagagagtgaggatcagtggtactagtgcctggtatctctgacttgggaacctgggaggttagttagcaggatgttgtgggtaggtagactggggatcattggtcaagagactttttatggtccttcctgtcccttttgttgcagggctgtgtggtctttgaggatgtgtttgtatacttctctcgggaagaatgggagcttcttgatgatgctcagagacttttgtaccatgatgtgatgctggagaactttgcacttttagcctcactgggaattgcattttccagatcacgtgcagtcatgaaactagagcgaggagaagagccctgggtgtatgaccaggtggatatgacttcagccacagaaagagaggcccagaggggacttagacctggttgttggcatggagtggaggatgaagaggtatcttctgagcagagcatttttgtagtaggagtgtcagaggtcaggactctcatggcagagctggagtctcacccatgtgacatatgtggcccaatattgaaagataccttacacctggctaaataccatgggggaaaagccaggcagaaaccatacttgtgtggggcatgtggaaagcaattctggttcagtacagactttgaccagcaccagaaccagcccaatggagggaaacttttcccaaggaaggagggcagagactctgtgaaaagctgcagagtccatgtgccagagaagaccctcacatgtgggaaaggtaggagagacttttcagccacatctggccttcttcagcatcaggcctctctcagcagcatgaagccccacaagagcactaagcttgtgagtggctttctcatgggacagaggtatcacaggtgtggtgaatgtgggaaagccttcacccgcaaagacacacttgctcggcatcagagaatccacactggagaaaggccttatgagtgtaacgaatgtgggaaattcttcagccaaagctatgacctctttaaacaccagacagttcacactggagaaaggccatacgagtgcagcgaatgtgggaaattctttagacaaatctccggcctgattgagcacaggcgagttcacacgggtgaaagactctatcagtgtggcaaatgtgggaaattttttagcagtaagtctaatctcattcgacaccaggaagttcacacaggagccaggccttatgtatgcagcgaatgtgggaaagagttcagtcggaaacacacacttgttctgcaccaacgaactcacactggagaaaggccttatgagtgcagtgaatgtgggaaggcctttagccaaagctcccaccttaatgtacactggagaattcacagcagtgattatgagtgtagcagatgtggtaaagctttcagctgcatctccaaactcattcagcaccagaaagttcactctggagaaaagccttatgagtgcagcaagtgcgggaaagccttcactcaaagacccaacctcatcaggcactggaaagtccacactggggaaaggccttatgtgtgtagtgagtgcgggagagaattcatccggaaacagacacttgttctgcaccagagggttcatgctggagaaaagctttaagagtgtagcaaatgtgggggaaagtcttaggccaatgcccccgacttactatatggtggggaactagcagtagttaatgagtgcagcagatgcaggaaagccttcccctggaggctgaaccttacccgccattgggaatttcacaccggacacaggccttagcagtctaagcaatgtgctgtctctgttcagcccaacagctcaccctagagtggaactctgggagcagccattgggagggaaccatcagtaagaagtgaaacttcatagatatggacattcccactggggagattccctgtgagtgccaagtatgtgagatgctttcagcagctgtgttgcactttttaaatggctattggcctttgctggggcaggagccatctgctcctaccatctggcagaatcatactgcgtttaccatttaccccagcatgcttgtgacgggcagacctctcttctctccccagtccctaaaaggtgttgtgagtggtctcacagcccactaggggtcttaatttcctctcttttgatgtaaatggcatggaaataatcagctttgttcaagaggacacagaaggattctgcaaatagcctgcagagacttacctgtgttgattgatttcatatgatgctcgttatggatatatccaatatccaagtcacccagctctggaactgcctgcttcacattgctcatgataataaaggcctgttctttaagccaccaaaaa

SEQ ID NO: 73145 - DNA, 2434 bp, Homo sapiens
gtggaggcggaatatgtgagtacctcgattacgtagaatgggccgagattatgaggcggtacagtcgattttgccggcaacccgcagattcggttttatgacagtcggccaagggggcatttgtcgttggacctgacacctgggaggttagttagcaggatgttgtgggtaggtagactggggatcattggtcaagagactttttatggtccttcctgtcccttttgttgcagggctgtgtggtctttgaggatgtgtttgtatacttctctcgggaagaatgggagcttcttgatgatgctcagagacttttgtaccatgatgtgatgctggagaactttgcacttttagcctcactgggaattgcattttccagatcacgtgcagtcatgaaactagagcgaggagaagagccctgggtgtatgaccaggtggatatgacttcagccacagaaagagaggcccagaggggacttagacctggttgttggcatggagtggaggatgaagaggtatcttctgagcagagcatttttgtagtaggagtgtcagaggtcaggactctcatggcagagctggagtctcacccatgtgacatatgtggcccaatattgaaagataccttacacctggctaaataccatgggggaaaagccaggcagaaaccatacttgtgtggggcatgtggaaagcaattctggttcagtacagactttgaccagcaccagaaccagcccaatggagggaaacttttcccaaggaaggagggcagagactctgtgaaaagctgcagagtccatgtgccagagaagaccctcacatgtgggaaaggtaggagagacttttcagccacatctggccttcttcagcatcaggcctctctcagcagcatgaagccccacaagagcactaagcttgtgagtggctttctcatgggacagaggtatcacaggtgtggtgaatgtgggaaagccttcacccgcaaagacacacttgctcggcatcagagaatccacactggagaaaggccttatgagtgtaacgaatgtgggaaattcttcagccaaagctatgacctctttaaacaccagacagttcacactggagaaaggccatacgagtgcagcgaatgtgggaaattctttagacaaatctccggcctgattgagcacaggcgagttcacacgggtgaaagactctatcagtgtggcaaatgtgggaaattttttagcagtaagtctaatctcattcgacaccaggaagttcacacaggagccaggccttatgtatgcagcgaatgtgggaaagagttcagtcggaaacacacacttgttctgcaccaacgaactcacactggagaaaggccttatgagtgcagtgaatgtgggaaggcctttagccaaagctcccaccttaatgtacactggagaattcacagcagtgattatgagtgtagcagatgtggtaaagctttcagctgcatctccaaactcattcagcaccagaaagttcactctggagaaaagccttatgagtgcagcaagtgcgggaaagccttcactcaaagacccaacctcatcaggcactggaaagtccacactggggaaaggccttatgtgtgtagtgagtgcgggagagaattcatccggaaacagacacttgttctgcaccagagggttcatgctggagaaaagctttaagagtgtagcaaatgtgggggaaagtcttaggccaatgcccccgacttactatatggtggggaactagcagtagttaatgagtgcagcagatgcaggaaagccttcccctggaggctgaaccttacccgccattgggaatttcacaccggacacaggccttagcagtctaagcaatgtgctgtctctgttcagcccaacagctcaccctagagtggaactctgggagcagccattgggagggaaccatcagtaagaagtgaaacttcatagatatggacattcccactggggagattccctgtgagtgccaagtatgtgagatgctttcagcagctgtgttgcactttttaaatggctattggcctttgctggggcaggagccatctgctcctaccatctggcagaatcatactgcgtttaccatttaccccagcatgcttgtgacgggcagacctctcttctctccccagtccctaaaaggtgttgtgagtggtctcacagcccactaggggtcttaatttcctctcttttgatgtaaatggcatggaaataatcagctttgttcaagaggacacagaaggattctgcaaatagcctgcagagacttacctgtgttgattgatttcatatgatgctcgttatggatatatccaatatccaagtcacccagctctggaactgcctgcttcacattgctcatgataataaaggcctgttctttaagccaccaaaaa

SEQ ID NO: 73146 - DNA, 2127 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73147 - DNA, 621 bp, Homo sapiens
agccgcagtgacttagagatcccccgggccagtatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtcgtactgcccgggggatctctaaagtcgactgcagg

SEQ ID NO: 73148 - DNA, 415 bp, Homo sapiens
aaatggagtttttgccagctggcaaggcagaatccataggcggccatcgtcatctgaaccagttcatagctcatgctgctctagacctcgtagatgagaacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73149 - DNA, 316 bp, Homo sapiens
gagcctggtccgggagtggagagagaagggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccagagagatcaagagaacgggcatcgccagctgcccggggggccttcactttgcagtcatcatctgtacaaactcttcataattgacctggccatctccatcgatgtcagcct

SEQ ID NO: 73150 - DNA, 296 bp, Homo sapiens
  misc_feature (269)..(269): n is a, c, g, or t
  misc_feature (279)..(279): n is a, c, g, or t
ctgaccccttgtgcttcccaggtgaggtgatgcctcgccctgcttcggctcacgctcggtgcgctgcaccactgtcctgaacccactgtcgagttggggacagtgatgagatccctgggacagaaccccactgaagcagagctgcaggatatgatcaatgaggtggatgcagatgggaacgggaccattgacttcccggagttcctgaccatgatggccagaaagatgaaggacacatattatgtagtaccatagttagtaaattcgtnaaaaccttgngaagccattattttggt

SEQ ID NO: 73151 - DNA, 449 bp, Homo sapiens
ttctccatcctttccccaccttccagggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtccca

SEQ ID NO: 73152 - DNA, 645 bp, Homo sapiens
gctgtggccttcccactcagcactgctagctcctcatcctcctggcttggcagccgtcccctcgctttccatccccccatcaaccccacgcactgtccgtcagccatgttctgctgccgaccacccccacgctcaccacacgcagtggctcagctcctttggaagctggtagcacccacggcaaggaacagggctgccagtcagaagggagtggatgcctgcatttcctcttcaggccggccagaggcattctgcagcctcccctcctcgtcccagccagccaaccctggctaacacactcagacaaagaatcctttcggctctcattcactccatgactttggttcatttcatcatttcaagggagaagtcaaagccagggaccaaacagaaatgtagaatcatctaaggacagctgtcagaccattttccccactgtcttcactggctggccagaaaaatagcttcacctagcacagtgttgatgttcaataactgttgaatgaaggttggaagggctttgccctgagcactgaggagagagagctggttgcgtgggacttgaagtctgtctcagtttctttaggtatctgagtgcctgtaaggatttttaagggcttgctagtttaaggcaggacctctata

SEQ ID NO: 73153 - DNA, 2321 bp, Homo sapiens
gaaaaggggaaaaaacccagacgactgaactgcccacattgacttacttgtcccagaggcgaaagtcagaagcaagggcacggttcatgctctccgctgggggagtatgggggcaggcaggtgggcgagggaagggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73154 - DNA, 2193 bp, Homo sapiens
aggtatctagagatccgtgtcatccccttcgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73155 - DNA, 2123 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccacctcaggctagtcgggtaatccctggagagtcac

SEQ ID NO: 73156 - DNA, 2118 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccccaatcaacctctatgctttcttctta

SEQ ID NO: 73157 - DNA, 1943 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtcgtactgcccgggggatctctaaagtcgactgcagg

SEQ ID NO: 73158 - DNA, 1941 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgttgagtcccacaatcgaaggggatccatcatagag

SEQ ID NO: 73159 - DNA, 2146 bp, Homo sapiens
agcgcgcgcgcgcccggcggcaaacccaattcctgtgcagggtggggacgagagattcgcgggcccgtaggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73160 - DNA, 2219 bp, Homo sapiens
tcctgcaggctctgtctgaggcgccgcatctcttcctgtgtgggctcgcgctcttccatccatgtcttccaaggcctgatgcattcataagttgaagccctccccatcattttcttcttccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73161 - DNA, 2291 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73162 - DNA, 2238 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73163 - DNA, 1923 bp, Homo sapiens
tcggccggtccgggagtggagaggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73164 - DNA, 1724 bp, Homo sapiens
  misc_feature (1703)..(1703): n is a, c, g, or t
  misc_feature (1705)..(1705): n is a, c, g, or t
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcctccgaggggtacnanctcgagttcgatactgtac

SEQ ID NO: 73165 - DNA, 1723 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggccctggcccttatcgagggtactgagctcgagttc

SEQ ID NO: 73166 - DNA, 2214 bp, Homo sapiens
gaaaaggggaaaaaacccagacgactgaactgcccacattgacttacttgtcccagaggcgaaagtcagaagcaagggcacggttcatgctctccgctgggggagtatgggggcaggcaggtgggcgagggaagggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73167 - DNA, 2245 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagcaaccccagcactgactcctttggcccagaggtggaagagcctctcctcaaagctggctctgaagctgtgtccagtcagtgcagcccagtggacgcctctgaaccacagttctgatcccagctagatcg

SEQ ID NO: 73168 - DNA, 1409 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggaatgccccctcaccccctcctgggccacatccgtactgcccggtaccgaggctc

SEQ ID NO: 73169 - DNA, 1690 bp, Homo sapiens
gctcggtacccgtactgttccacagggtatgaagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73170 - DNA, 1717 bp, Homo sapiens
ctcgatactcgagctgtttctgccggtgacatcgatcgagatggccagctcaattatgaagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73171 - DNA, 1832 bp, Homo sapiens
ggtagacagcggtggtaattggacagaggtatcgctcgagagcttatacgtagtgacgaacctgagggtagaactgtccgatgagcgataggtgtcgtatcatgatcacagcatggctgagtatcgatggaggatagcagtgtgaacttatgaatagttagtacaagatagattgactagtaaacgtagaagttgcccctgggtagtagatcagtgagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73172 - DNA, 1641 bp, Homo sapiens
ggacgcgtgggtcgacccacgcgtcggctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73173 - DNA, 1548 bp, Homo sapiens
ctgatttcaaatgcttctgatgctttaggattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73174 - DNA, 1434 bp, Homo sapiens
ggacgcgtgggtcgacccacgcgtcgtcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73175 - DNA, 1447 bp, Homo sapiens
  misc_feature (1447)..(1447): n is a, c, g, or t
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccgttcccctgagttggacaacctaattgggggcccgcggcatggatggaccagcccccggctcccaggacacccgcttggagagggcaaaaaaggggctcccccaggaaaaaagcagccactttgggagtcatagaaccagcgcggaataagccgtgaaaccaccacgctggtggagagagcgtcaactaaacgcacacgaagcggcagatagcaaactacagttagaccgagaagaacggacgaaagcaggagagcgagcaagtcggttactgacagccacagcagaatgaaataacgaaagcgacccagtccacctaggccacgcactgcattatgn

SEQ ID NO: 73176 - DNA, 1076 bp, Homo sapiens
ataaacagctcggtaccgggcagtatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73177 - DNA, 1085 bp, Homo sapiens
agccgcagtgacttagagatcccccgggccagtatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73178 - DNA, 1097 bp, Homo sapiens
  misc_feature (46)..(46): n is a, c, g, or t
gcggcgttatagaggatccccgtgacaggacagataggtaccaggntgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73179 - DNA, 1196 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgcccctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73180 - DNA, 1044 bp, Homo sapiens
tgatacgacttcgagttcaggtactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73181 - DNA, 1029 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgcccagttgatagcggaatcgcctcagttgatag

SEQ ID NO: 73182 - DNA, 929 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtccca

SEQ ID NO: 73183 - DNA, 993 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgtgaaaagtaggggatcctcctagagtcaccc

SEQ ID NO: 73184 - DNA, 1152 bp, Homo sapiens
atgggatcaggtcacagaatgaataagaggcagatttagagttttaacccaggtccttgctctatatatagtgtttttgatgggaatggctacatcagcgccgcagagctgcgtcacgtaatgacgaacctgggggagaagctgaccgatgaggaggtggatgagatgatcagggaggctgacatcgatggagatggccaggtcaattatgaagtggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73185 - DNA, 1032 bp, Homo sapiens
ctaatagctaaatcactctacagcagactgacctagaacaaggagatactttccacgtggatcgttgttctgtgcacatttgatagtgttcgtgatgttagaatgtctggacagggatcatctctggcgcgattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73186 - DNA, 1636 bp, Homo sapiens
  misc_feature (961)..(961): n is a, c, g, or t
  misc_feature (967)..(967): n is a, c, g, or t
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaaaaaaaaacaaaaaaaaaaaaaaaaaaaaaanaaaaanaaaaaaaaaaaaaaaaaaaaaaaaaaaaaaaaaaaaaaggaatgattcccgccccagaaaaaaaaccccctcggtggggccgcaccaacaaccccgcatgaaaaaagaggaggaggtgaattctacaccccccaaagcgaccccaccgaagtaaacaagcgcccctgggcggcgcacaaagcgagcggtccaacaaagggaggaaggcggcggaccgggtcacagacgacggggaaaccccaccgccgaacgactcgcgggggacacaagccgacgcagggggtgccttccaaccaaaggacaacataggagcaggagacccaccggcccgcggggagagggagcgccaaacaaaaaacactccggtggctgtgtgtgtgtaggtaaccccaacaaatgaatggcgcagagtaacattttgtgggtcgaacataccacgcgtgccaagtctttcgccacaaagacgatgctctgtcgggtgccgtttgtgataagctccgccgccgatattacaaatggcgtgtttaggctggacccaattgctccggcggaataccaactgagcgtggcgacaaccttgtagtagcggggcacagcgggagataaattcgccttgtcgcaaagatgtgagtgtgccgcgcagcattggtgcttctgggaccgtataag

SEQ ID NO: 73187 - DNA, 1163 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccacacaagaagacactggggcatatttacccgtgatcaacctcaatataaattaaaagaatctccgggggggggccccggtgcccaatagcccctaatatgggggctttctcatttcactgggccggatgaaatcaacggggagcaggaaagatccctttgcgatacccagatcttaaagttcgaagcgacttcatcttgtggaacggtctccgaggccactcgcatgggctctac

SEQ ID NO: 73188 - DNA, 980 bp, Homo sapiens
ggttttccgagatcccaaaaaccaggttaccccggctttattgcaaatttaatacgagtccctcccttaatagggagacccccgccgaatattttccccctcttgtacacaaaaaaacggggtccacagaaaaaaacccaagaaaacacctctggcccctttctatctataaccctctttttccccccacccaaaaaaaaagcccccgaaatttttttttttttttttttttttttttttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73189 - DNA, 991 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtacatgcgcgcacaccgactgaaggaggatgagcatatgattaagcaacccaagagttgacactcagtcgcagtgtttgatatttttccttattgaccagactatctctaccaggcccctcatatcggtc

SEQ ID NO: 73190 - DNA, 690 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaagatgggaatggctccaagcgccacccaacgtgccacccgatgtgcctccccaagcgccacccaaagagccaccaagag

SEQ ID NO: 73191 - DNA, 557 bp, Homo sapiens
aggtatctagagatccgtgtcatccccttcgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgccaagattgagctctctgcccttgatcagccccacctggcctagaccagcagacagagccaggagaagctcactgcattcccagccccacccccaagttctccaacatcacacccacccgcccgccgggatctcta

SEQ ID NO: 73192 - DNA, 388 bp, Homo sapiens
aggtatctagagatccgtgtcatccccttcgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtccca

SEQ ID NO: 73193 - DNA, 387 bp, Homo sapiens
tggctgttctagaggatcccaactcaggggcgagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcacgcccctgagttgcagctcgccactgagctgca

SEQ ID NO: 73194 - DNA, 310 bp, Homo sapiens
ccacccgacggcgtgcgggggagagagagagtccagaattcgccccgaactggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggccgtgtttcatccgctgtgacctgctctcgtaccacgggaa

SEQ ID NO: 73195 - DNA, 363 bp, Homo sapiens
  misc_feature (324)..(324): n is a, c, g, or t
tcctgcaggctctgtctgaggcgccgcatctcttcctgtgtgggctcgcgctcttccatccatgtcttccaaggcctgatgcattcataagttgaagccctccccatcattttcttcttccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatggaacgnggaccattgacttcccggaagaagaaaatatccgggtac

SEQ ID NO: 73196 - DNA, 2407 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73197 - DNA, 3114 bp, Homo sapiens
  misc_feature (2439)..(2439): n is a, c, g, or t
  misc_feature (2445)..(2445): n is a, c, g, or t
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctgaaaaaaaaacaaaaaaaaaaaaaaaaaaaaaanaaaaanaaaaaaaaaaaaaaaaaaaaaaaaaaaaaaaaaaaaaaggaatgattcccgccccagaaaaaaaaccccctcggtggggccgcaccaacaaccccgcatgaaaaaagaggaggaggtgaattctacaccccccaaagcgaccccaccgaagtaaacaagcgcccctgggcggcgcacaaagcgagcggtccaacaaagggaggaaggcggcggaccgggtcacagacgacggggaaaccccaccgccgaacgactcgcgggggacacaagccgacgcagggggtgccttccaaccaaaggacaacataggagcaggagacccaccggcccgcggggagagggagcgccaaacaaaaaacactccggtggctgtgtgtgtgtaggtaaccccaacaaatgaatggcgcagagtaacattttgtgggtcgaacataccacgcgtgccaagtctttcgccacaaagacgatgctctgtcgggtgccgtttgtgataagctccgccgccgatattacaaatggcgtgtttaggctggacccaattgctccggcggaataccaactgagcgtggcgacaaccttgtagtagcggggcacagcgggagataaattcgccttgtcgcaaagatgtgagtgtgccgcgcagcattggtgcttctgggaccgtataag

SEQ ID NO: 73198 - DNA, 2428 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccaaaaaatctgacacgaaaggaagacccccacaacgcatgtggtttccacatcaactggcacgaggtaggtcacaaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73199 - DNA, 2186 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccgctctgggcacctacctgtcgacttcaccttcctgccacatgatgagcagttgctatgtccaactgagtctgtggggtgccaggtgagtacctcc

SEQ ID NO: 73200 - DNA, 1987 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccaccaacctggtgccctacccccgcatccacatccgtactggcccg

SEQ ID NO: 73201 - DNA, 2192 bp, Homo sapiens
agcgcctgcctccagcctgaccagagttctttaggtgcttgagcaactcgggccgccggttaggagaatttttgccacttgggtggactctgcctgagccaaccgcctccaaataggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73202 - DNA, 2739 bp, Homo sapiens
gctgtggccttcccactcagcactgctagctcctcatcctcctggcttggcagccgtcccctcgctttccatccccccatcaaccccacgcactgtccgtcagccatgttctgctgccgaccacccccacgctcaccacacgcagtggctcagctcctttggaagctggtagcacccacggcaaggaacagggctgccagtcagaagggagtggatgcctgcatttcctcttcaggccggccagaggcattctgcagcctcccctcctcgtcccagccagccaaccctggctaacacactcagacaaagaatcctttcggctctcattcactccatgactttggttcatttcatcatttcaagggagaagtcaaagccagggaccaaacagaaatgtagaatcatctaaggacagctgtcagaccattttccccactgtcttcactggctggccagaaaaatagcttcacctagcacagtgttgatgttcaataactgttgaatgaaggttggaagggctttgccctgagcactgaggagagagagctggttgcgtgggacttgaagtctgtctcagtttctttaggtgggactgatgcccttggccttcctccagggaaggcatccagcatccagaggtaaggattctcctgtggaccttgtgacctctgactcctcccccttcttcccccagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73203 - DNA, 2107 bp, Homo sapiens
attcgaatcggagctcggtcacgctaactcaggggcgagctgctaactcaggggcgagctgctaactcaggggcgagctgctaactcaggggcgagctgctaactcaggggcgagctgctaactcaggggcgagctgctaactcaggggcgagctgctaactcaggggcgagctgcaggatacgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73204 - DNA, 1873 bp, Homo sapiens
cggtacccttttggtctttgctggggtctttgctgacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73205 - DNA, 1862 bp, Homo sapiens
  misc_feature (26)..(26): n is a, c, g, or t
  misc_feature (29)..(29): n is a, c, g, or t
  misc_feature (32)..(32): n is a, c, g, or t
  misc_feature (67)..(67): n is a, c, g, or t
gtgatgccagtctccagagtatcccngcnctngagaagagacgagatgcgttccgtgtctttgacanggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73206 - DNA, 1789 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccacgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcaacctccccaccccaccccccaccccctgcttcccctcactgcccaggtcgatcaagtggcttttcctgggacctgcccagctttgagaatctcttctcatccaccctctggcacccagcagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73207 - DNA, 1410 bp, Homo sapiens
  misc_feature (15)..(15): n is a, c, g, or t
gcaggtgaccattgncacacgctagaagtttatggcagagctttacaaataaaaaaaaaactggcaaaaaaaaaaaaaaaaaactcgagactagatctctctctcttctctcattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73208 - DNA, 1687 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagtggctgggtggggactgctcatttggccactctgcagattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73209 - DNA, 1099 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgcccgtctcttctcttgtaaagagacgatatgctgggacctggggaaccaaggataggggaaggagtcagcacagtgaaaggcgccatatcctgcccacatgtc

SEQ ID NO: 73210 - DNA, 1159 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73211 - DNA, 1160 bp, Homo sapiens
  misc_feature (931)..(931): n is a, c, g, or t
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccatncatgccaaaacataagctttcagtgcctatcacatatggcttttcactgtctctactgagggactgaggaatttatttctgaagtctgggggggggggcctgactcccatttccctctactaagggttctttttaaaacattgcgcggtctttgactaccctttgtgaggggcctttgcttttcccatttaagcgacttggctacccgtttcgggggggttatggcgtg

SEQ ID NO: 73212 - DNA, 1127 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctga

SEQ ID NO: 73213 - DNA, 1006 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtagggatacagctgtatccggggagccatcccagagaatgtccatagaaatgcctgtgagtccctacaccttaatgactcatttgcaaatacacttataatatatgtggacaccttttgatctcttatccctccccgggatacag

SEQ ID NO: 73214 - DNA, 848 bp, Homo sapiens
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaaatgaagacctactttcaactcctttttcccccctctagaagaatcaaattgaatcttttacttacctcttgcaa

SEQ ID NO: 73215 - DNA, 1440 bp, Homo sapiens
  misc_feature (765)..(765): n is a, c, g, or t
  misc_feature (771)..(771): n is a, c, g, or t
agcgcgcgcgcgcccggcggcaaacccaattcctgtgcagggtggggacgagagattcgcgggcccgtaggtgtggagcggggcgcggagggatccgtgggagccgcagtgcggcggcgcgcgggccgggtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacaagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctgaaaaaaaaacaaaaaaaaaaaaaaaaaaaaaanaaaaanaaaaaaaaaaaaaaaaaaaaaaaaaaaaaaaaaaaaaaggaatgattcccgccccagaaaaaaaaccccctcggtggggccgcaccaacaaccccgcatgaaaaaagaggaggaggtgaattctacaccccccaaagcgaccccaccgaagtaaacaagcgcccctgggcggcgcacaaagcgagcggtccaacaaagggaggaaggcggcggaccgggtcacagacgacggggaaaccccaccgccgaacgactcgcgggggacacaagccgacgcagggggtgccttccaaccaaaggacaacataggagcaggagacccaccggcccgcggggagagggagcgccaaacaaaaaacactccggtggctgtgtgtgtgtaggtaaccccaacaaatgaatggcgcagagtaacattttgtgggtcgaacataccacgcgtgccaagtctttcgccacaaagacgatgctctgtcgggtgccgtttgtgataagctccgccgccgatattacaaatggcgtgtttaggctggacccaattgctccggcggaataccaactgagcgtggcgacaaccttgtagtagcggggcacagcgggagataaattcgccttgtcgcaaagatgtgagtgtgccgcgcagcattggtgcttctgggaccgtataag

SEQ ID NO: 73216 - DNA, 853 bp, Homo sapiens
gtcagagtttgagatgcaaatcctttactgtatagccttgatcaaatgacttcacctcattgaattaatcttcttctgcataaaatggggtcaccatctgcttatctaaattgttacaaatgggacagtatatgtgccattccagatacctaatcacagctcaatcgatgctggtgtctttttcctttttccttctgcagaaaacatgctttacataggatctctgaacttaaagaatgggaagaagaaaaatcatgtttccagcttgggctgctgtttcatctgttggacttgctgtgagctaagccaaatttcattaaaaattatggtctcataaaaaaaaaaaaaaaaaaaaaaaaaaaaaaaaaaaaaaaaaaaaaaaaaaaaaaaaaaaaaaaaaagggggggggggcccaaagaaaatccccccggagggggcgccagaagtatcagcgcgcgcacccccgagttttgttggacaaaagggggcgccccatataagagggcgtcgataataataaagcagggagagcggcgggcgagcgggttgtaaaaaaaacgggcgggagcgggggagaacaaggcggcgatcgcggggagacaccttgggagaaggaggaacaccacacttaccgcgagggggggggagacaaccatgtggtgggaacaaaactctatcactaaaaagaataatattaagaggctcctaggggggaaaatattaaaagattttgaaggggggtatatatgtggggtgtgtaaaaaaagcgggtagtatattctgtgcgggtgtgagtaaaaattgtggggcaactacggagtaatatattattgtgaaaaaaaattttttgcc

SEQ ID NO: 73217 - DNA, 541 bp, Homo sapiens
gtcagagtttgagatgcaaatcctttactgtatagccttgatcaaatgacttcacctcattgaattaatcttcttctgcataaaatggggtcaccatctgcttatctaaattgttacaaatgggacagtatatgtgccattccagatacctaatcacagctcaatcgatgctggtgtctttttcctttttccttctgcagaaaacatgctttacataggatctctgaacttaaagaatgggaagaagaaaaatcatgtttccagcttgggctgctgtttcatctgttggacttgctgatccctgaatggaaaggaatgctatgcacactttttggatacaggaagtgagattcagaggggttaaacagctttcctaaagccacacagcgagagagtcgatctgaactgaagattgtttgacatcaaagctcatttctttccctaaatgtcagcattctttcctgacttattaatttgatttctgtcctcccctcatggaagttaattaaaggaatgcgagaaccttttagaaaatctccag

SEQ ID NO: 73218 - DNA, 408 bp, Homo sapiens
cgtggctcaaatcctccaactgcaggactgccggccctgggactcatgaataatggaagtgcagtaaccactccttacagcccagacgactttccaggagcaggctgtaccccgaaagtaaacaaggaacaaggggcaaggagacagagagagatggggaaatgatccctgaatggaaaggaatgctatgcacactttttggatacaggaagtgagattcagaggggttaaacagctttcctaaagccacacagcgagagagtcgatctgaactgaagattgtttgacatcaaagctcatttctttccctaaatgtcagcattctttcctgacttattaatttgatttctgtcctcccctcatggaagttaattaaaggaatgcgagaaccttttagaaaatctccag

SEQ ID NO: 73219 - DNA, 274 bp, Homo sapiens
ggatgatggcagtgggaattcaaaaagaaggtaactttgaggcatctcaaatgtagattaggcaagacaggcatgagtctgaaaaagagaggcaatgaaaagaggaatggtttgaaggtgagatgcagaagcttaattttaggtgtggtaagttttaatagctggtgacatgtcttggtagaagagtccagcaagaaatgtcattatgggtactaatgcttgagaaagattggttatagagatgcagatttagattatttcacccagaaaatgt

SEQ ID NO: 73220 - DNA, 445 bp, Homo sapiens
cctggggtgtttctttacatatacttgaaccagaatagcatatcacagcaagttgaacacagaagcatgtcggcagatccgcctgtcttctgttgagtattgaagatacatgcaaaaatgtacaacatggccattttctcgctggtttctttttgaaaataaggttattttcataaaatattacttaacatgaagtgaacctattgctaatttaatgaataagtaaatatttttaaaattttcaagtatggtcagtatcaatggatataacccccataatcaaagctctttagggttctccatactttctaagaatgtaaataggtcttgacaccaaaaaaatggaaaacacgtggacttggaagtttttctcgaatgggctggatgtgaccctgaccctgtttttaccaagcctccttggttttttccctcttttctctaaaaa

SEQ ID NO: 73221 - DNA, 2913 bp, Homo sapiens
acataatcttcactgaacataaatgtgttcatctaaagcaatctcttagtacatcaatttggtgcattttaattagagaaaatcattttctctattgaagagaatccatccactcatgtcctataaattatagtaaataaggaaaagcatatataacattctgaatttcctaggtgtctttggaaacaggtaagttactcaggtgaataaaggtgaaaaaagtcttgtcagaaaaggaatgattatattagccaaatttaattaccaggttttgatcttcattaagcaaagcaaagaacttctttactgattccttgtccttcagtaaggaaaaagacaaaactctccttagtttacacattatttatggtcagtttttaataaatcttgttttttttcttaaccagcaagagaattgatacaaagtataaatccagagtcatgtagaaaacttggaagtattaataaaacagattacagtttgtgcactgaatagtcatcttaattgattgtttaatggagaagcaaactggatgaccttagacaaaataacatttatctatgaagcttattttcctcatctttaaaacagaactacaaaaatgcagagagttcaagggcaggcacatagttgataactggtgctagttcttctatttaattatattccatctttgttgagagatttgaggtagctcctgttgcagtattaatttataatattttaaaagttagagaactttcctttgggatgttttaaaattatttccctggtcataattaatattagggtctgtttatttcaaatacaaaatattttaatcttttcttcctactgggttaagaccaaatgagatgtttgtttttaatgtataaaatcttatacagtgtatgttagctgcaacttctcaggaattctgaatcttagaacttttttattgaaagagatcttagaagccatctaaccaacccagattgcttaatgattgtctgggttcacatagctatgggtgatagaaaccgggattcgttgtgaccagtaattctccattctttctccctaatgtgcagcacatctccagtacttctgaatagattacacagcttttctttggctagtttgggggcttgacctgatgcaaaaaggaatttttttcctctgccaacaaaatttctcactgcactgcttgctacacagacaagattcaaaataaaagtaatggtgggtcaggtgccatggctcatgcctgtaatcccagcactttgggaggccgaggtgggcagatcacgaggtcagatcaagaccattctggccaacatggtaaaaccccgtctctactaaaaatagaaaaattaaatgttacatgaaaaacatatttgaaactgtactgccatttgtgtaaaacaaggtatgtggtgtgtgaacatcttatttgcatatgcatataattatctctaaggatgcacgagaaaccagtgataattatgcctccaagaagaggttcaactaggtgggctgcttagaatctagttttgtattatttggacttttgttcacattatcctttcaaaatacattttaaaaatactatatgcaccgaggtgggtggatcatctgaactcaggagttcgagaccagcctgggcaacatggcgaaaccttgtctctaccaaaaatacaaagaattagctggctgtggtggtgtgcgcctgtagtcccagctactcaggaggctaagataggaggatcacttgagcctgggaggtgcaggttgcagtgagctggaattgtgcaactgcactccagcctgggtgacagagtgagaccctgtctcaaaaaaaaaaaaaaaaaaaaaatattatatgcagagctggggagtggtggtccacacctgtagtcccagcatcttgggaggctgaggcaggaggagtgcttgaagccaggagttcaagttcagtctgggcaacatggggagacctgtctcaaaaaaaaaaactaaacagagtgtaattattagcatttcataacattatttgtcttggtatttgaatacattagaattctatttgtcctgtaattaatttctaactcactttgataaaataccaaaacaaaggaaacaaagtcaacaaaacttaatttgtatccttcatccttttgaacagcagctatgtgaacatttggaaagaaccttagtaaggcggcttttctatcacctataaaaagttgccaacagacatcaaaggagttgacaaaaaaaaaaaaaaatgcaggaagctggaaggcaggcctggatggaattggaactgtgctgctgtgactcctttccccagtgctaaaaaatagatgtagtcaggaggaactaacatagattggcagtcacccacacatctctggtgttaccttagtcttgtttcaagcatacaagccacaagtttttgggtgtcttaaatatacctaagttgtagtctctatttatttttttattatacttttaagttctagggtacatgtgcacaacgtgcaggtttgttacatatgtatacatgtgccatgttggtgtgctgcacccgttaactcgtcatttacattaggtatatctcctaatgctatccctccccctcccccaaccccacgatgtagtctctttctaagttccattaaacagaatactaaaatgaccttttttggtgactcttgcctgtctctaccactaactggcttaaaagctgctgggtctcttcctttgtaaagagcaacatgagtttacagatgaggtctgtctatatctcctcttatgtttttctcttaagaacttcaagtgaaataaaacaaaatagctcttttatgaatactaccttttgtattttacctcataagatttaatgtattaaacatttctataccaacatg

SEQ ID NO: 73222 - DNA, 2460 bp, Homo sapiens
gactctagcaggagtcttactagacagtttgtgcactgaatagtcatcttaattgattgtttaatggagaagcaaactggatgaccttagacaaaataacatttatctatgaagcttattttcctcatctttaaaacagaactacaaaaatgcagagagttcaagggcaggcacatagttgataactggtgctagttcttctatttaattatattccatctttgttgagagatttgaggtagctcctgttgcagtattaatttataatattttaaaagttagagaactttcctttgggatgttttaaaattatttccctggtcataattaatattagggtctgtttatttcaaatacaaaatattttaatcttttcttcctactgggttaagaccaaatgagatgtttgtttttaatgtataaaatcttatacagtgtatgttagctgcaacttctcaggaattctgaatcttagaacttttttattgaaagagatcttagaagccatctaaccaacccagattgcttaatgattgtctgggttcacatagctatgggtgatagaaaccgggattcgttgtgaccagtaattctccattctttctccctaatgtgcagcacatctccagtacttctgaatagattacacagcttttctttggctagtttgggggcttgacctgatgcaaaaaggaatttttttcctctgccaacaaaatttctcactgcactgcttgctacacagacaagattcaaaataaaagtaatggtgggtcaggtgccatggctcatgcctgtaatcccagcactttgggaggccgaggtgggcagatcacgaggtcagatcaagaccattctggccaacatggtaaaaccccgtctctactaaaaatagaaaaattaaatgttacatgaaaaacatatttgaaactgtactgccatttgtgtaaaacaaggtatgtggtgtgtgaacatcttatttgcatatgcatataattatctctaaggatgcacgagaaaccagtgataattatgcctccaagaagaggttcaactaggtgggctgcttagaatctagttttgtattatttggacttttgttcacattatcctttcaaaatacattttaaaaatactatatgcaccgaggtgggtggatcatctgaactcaggagttcgagaccagcctgggcaacatggcgaaaccttgtctctaccaaaaatacaaagaattagctggctgtggtggtgtgcgcctgtagtcccagctactcaggaggctaagataggaggatcacttgagcctgggaggtgcaggttgcagtgagctggaattgtgcaactgcactccagcctgggtgacagagtgagaccctgtctcaaaaaaaaaaaaaaaaaaaaaatattatatgcagagctggggagtggtggtccacacctgtagtcccagcatcttgggaggctgaggcaggaggagtgcttgaagccaggagttcaagttcagtctgggcaacatggggagacctgtctcaaaaaaaaaaactaaacagagtgtaattattagcatttcataacattatttgtcttggtatttgaatacattagaattctatttgtcctgtaattaatttctaactcactttgataaaataccaaaacaaaggaaacaaagtcaacaaaacttaatttgtatccttcatccttttgaacagcagctatgtgaacatttggaaagaaccttagtaaggcggcttttctatcacctataaaaagttgccaacagacatcaaaggagttgacaaaaaaaaaaaaaaatgcaggaagctggaaggcaggcctggatggaattggaactgtgctgctgtgactcctttccccagtgctaaaaaatagatgtagtcaggaggaactaacatagattggcagtcacccacacatctctggtgttaccttagtcttgtttcaagcatacaagccacaagtttttgggtgtcttaaatatacctaagttgtagtctctatttatttttttattatacttttaagttctagggtacatgtgcacaacgtgcaggtttgttacatatgtatacatgtgccatgttggtgtgctgcacccgttaactcgtcatttacattaggtatatctcctaatgctatccctccccctcccccaaccccacgatgtagtctctttctaagttccattaaacagaatactaaaatgaccttttttggtgactcttgcctgtctctaccactaactggcttaaaagctgctgggtctcttcctttgtaaagagcaacatgagtttacagatgaggtctgtctatatctcctcttatgtttttctcttaagaacttcaagtgaaataaaacaaaatagctcttttatgaatactaccttttgtattttacctcataagatttaatgtattaaacatttctataccaacatg

SEQ ID NO: 73223 - DNA, 608 bp, Homo sapiens
ccagaacctcactactagtccaagttctcattctcaatttctttcttcctttaagtcattctacaaactattgatagagtaatctttcaaaggctctgattgcatcagtcttttctattcaaatatcttaaatggttcctcactatctactgttcaaagttcaaacctcctgttatgtggctctaaggcttttgatttgccactatccctgaatatcctacattttgttcactatgtctgtaggccaaaaaatacattgattatgtccaccacgcctgctgaaaaggtatccacaattcaagactcagttcaaactccatctccatgttaccccatctccctagtacggaagtaatctcttccttcttcatgtatagaaagtacctgacagcttcttgctgaccttgatgtcattctattttgcctttaaaggacatggacctttcttaattccattaattgaatatgacttgcatcaggattcttattcgctttccatagtgccttcaatggaggaggcagtgttaaacacagactattcatctggaattaaagactacttgtccagcctctgagctaaagtctaagtctgcttctgccttatttct

SEQ ID NO: 73224 - DNA, 484 bp, Homo sapiens
ccaaaatcaaggatgatttttcagaaatttttttggctttggcaactagacgatggtggtgccacttgtgtagatatctaggcaaggtaggagaccaggtttgggataaagattgctttagacattgagatatctttgggacatcctggtgaagatggcaggtagtttggtctcaaactgggaggtgccatctggggtggagatgaactgaggactcagtaactatagtcactgtaattttctgggggttgccattgctcagggagctcctagagtaagggactgagataggtcccaaggaatagacttgggagggccagggaatggggaggccactgaggtggtgggacaggctgcagggaagaatacctcaaaatcatacgaggccactctttgacaagtgtgcctgtttcaccgttttgtttgcacaagactctaagacagtatactgccttaaataaagtgcaccctgtttggaaaagtt

SEQ ID NO: 73225 - DNA, 4250 bp, Homo sapiens
  misc_feature (887)..(887): n is a, c, g, or t
  misc_feature (1305)..(1305): n is a, c, g, or t
  misc_feature (1344)..(1344): n is a, c, g, or t
  misc_feature (1653)..(1653): n is a, c, g, or t
ggcacgaggcggcgctgagtgacccgagtcgggacgcgggctgcgcgcgcgggaccccggagcccaaacccggggcaggcgggcagctgtgcccgggcggcacggccagcttcctgatttctcccgattccttccttctccctggagcggccgacaatgtccaccacggtcaatgtagattcccttgcggaatatgagaagagccagatcaagagagccctggagctggggacggtgatgactgtgttcagcttccgcaagtccacccccgagcggagaaccgtccaggtgatcatggagacgcggcaggtggcctggagcaagaccgccgacaagatcgagggcttcttggatatcatggaaataaaagaaatccgcccagggaagaactccaaagatttcgagcgagcaaaagcagttcgccagaaagaagactgctgcttcaccatcctatatggcactcagttcgtcctcagcacgctcagcttggcagctgactctaaagaggatgcagttaactggctctctggcttgaaaatcttacaccaggaagcgatgaatgcgtccacgcccaccattatcgagagttggctgagaaagcagatatattctgtggatcaaaccagaagaaacagcatcagtctccgagagttgaagaccatcttgcccctgatcaactttaaagtgagcagtgccaagttccttaaagataagtttgtggaaataggagcacacaaagatgagctcagctttgaacagttccatctcttctataaaaaacttatgtttgaacagcaaaaatcgattctcgatgaattcaaaaaggattcgtccgtgttcatcctggggaacactgacaggccggatgcctctgctgtttacctgcntgacttccagaggtttctcatacatgaacagcaggagcattgggctcaggatctgaacaaagtccgtgagcggatgacaaagttcattgatgacaccatgcgtgaaactgctgagcctttcttgtttgtggatgagttcctcacgtacctgttttcacgagaaaacagcatctgggatgagaagtatgacgcggtggacatgcaggacatgaacaaccccctgtctcattactggatctcctcgtcacataacacgtaccttacaggtgaccagctgcggagcgagtcgtccccagaagcttacatccgctgcctgcgcatgggctgtcgctgcattgaactggactgctgggacgggcccgatgggaagccggtcatctaccatggctggacgcggactaccaagatcaagtttgangacgtcgtgcaggccatcaaagaccacgcctttgttacntcgagcttcccagtgatcctgtccatcgaggagcactgcagcgtggagcaacagcgtcacatggccaaggccttcaaggaagtatttggcgacctgctgttgacgaagcccacggaggccagtgctgaccagctgccctcgcccagccagctgcgggagaagatcatcatcaagcataagaagctgggcccccgaggcgatgtggatgtcaacatggaggacaagaaggacgaacacaagcaacagggggagctgtacatgtgggattccattgaccagaaatggactcggcactactgcgccattgcngatgccaagctgtccttcagtgatgacattgaacagactatggaggaggaagtgccccaggatataccccctacagaactacattttggggagaaatggttccacaagaaggtggagaagaggacgagtgccgagaagttgctgcaggaatactgcatggagacggggggcaaggatggcaccttcctggttcgggagagcgagaccttccccaatgactacaccctgtccttctggcggtcaggccgggtccagcactgccggatccgctccaccatggagggcgggaccctgaaatactacttgactgacaacctcaccttcagcagcatctatgccctcatccagcactaccgcgagacgcacctgcgctgcgccgagttcgagctgcggctcacggaccctgtgcccaaccccaacccccacgagtccaagccgtggtactatgacagcctgagccgcggagaggcagaggacatgctgatgaggattccccgggacggggccttcctgatccggaagcgagaggggagcgactcctatgccatcaccttcagggctaggggcaaggtaaagcattgtcgcatcaaccgggacggccggcactttgtgctggggacctccgcctattttgagagtctggtggagctcgtcagttactacgagaagcattcactctaccgaaagatgagactgcgctaccccgtgacccccgagctcctggagcgctacaatatggaaagagatataaactccctctacgacgtcagcagaatgtatgtggatcccagtgaaatcaatccgtccatgcctcagagaaccgtgaaagctctgtatgactacaaagccaagcgaagcgatgagctgagcttctgccgtggtgccctcatccacaatgtctccaaggagcccgggggctggtggaaaggagactatggaaccaggatccagcagtacttcccatccaactacgtcgaggacatctcaactgcagacttcgaggagctagaaaagcagattattgaagacaatcccttagggtctctttgcagaggaatattggacctcaatacctataacgtcgtgaaagcccctcagggaaaaaaccagaagtcctttgtcttcatcctggagcccaagcagcagggcgatcctccggtggagtttgccacagacagggtggaggagctctttgagtggtttcagagcatccgagagatcacctggaagattgacaccaaggagaacaacatgaagtactgggagaagaaccagtccatcgccatcgagctctctgacctggttgtctactgcaaaccaaccagcaaaaccaaggacaacttagaaaatcctgacttccgagaaatccgctcctttgtggagacgaaggctgacagcatcatcagacagaagcccgtcgacctcctgaagtacaatcaaaagggcctgacccgcgtctacccaaagggacaaagagttgactcttcaaactacgaccccttccgcctctggctgtgcggttctcagatggtggcactcaatttccagacggcagataagtacatgcagatgaatcacgcattgttttctctcaacgggcgcacgggctacgttctgcagcctgagagcatgaggacagagaaatatgacccgatgccacccgagtcccagaggaagatcctgatgacgctgacagtcaaggttctcggtgctcgccatctccccaaacttggacgaagtattgcctgtccctttgtagaagtggagatctgtggagccgagtatgacaacaacaagttcaagacgacggttgtgaatgataatggcctcagccctatctgggctccaacacaggagaaggtgacatttgaaatttatgacccaaacctggcatttctgcgctttgtggtttatgaagaagatatgttcagcgatcccaactttcttgctcatgccacttaccccattaaagcagtcaaatcaggattcaggtccgttcctctgaagaatgggtacagcgaggacatagagctggcttccctcctggttttctgtgagatgcggccagtcctggagagcgaagaggaactttactcctcctgtcgccagctgaggaggcggcaagaagaactgaacaaccagctctttctgtatgacacacaccagaacttgcgcaatgccaaccgggatgccctggttaaagagttcagtgttaatgagaaccagctccagctgtaccaggagaaatgcaacaagaggttaagagagaagagagtcagcaacagcaagttttactcatagaagctggggtatgtgtgtaagggtattgtgtgtgtgcgcatgtgtgtttgcatgtaggagaacgtgccctattcacactctgggaagacgctaatctgtgacatcttttcttcaagcctgccatcaaggacatttcttaagacccaactggcatgagttggggtaatttcctattattttcatcttggacaactttcttaacttatattctttatagaggattccccaaaatgtgctcctcatttttggcctctcatgttccaaacctcattgaataaaagcaatgaaaaccttga

SEQ ID NO: 73226 - DNA, 653 bp, Homo sapiens
ctgggaacgcagccgcctccctcccctcctgtccctggcctgaccttttccttcttgttttccctgaaagcctcagagaaccgtgaaagctctgtatgactacaaagccaagcgaagcgatgagctgagcttctgccgtggtgccctcatccacaatgtctccaaggagcccgggggctggtggaaaggagactatggaaccaggatccagcagtacttcccatccaactacgtcgaggacatctcaactgcagacttcgaggagctagaaaagcagattattgaagacaatcccttagggtctctttgcagaggaatattggacctcaatacctataacgtcggtacgtgcacacatcatcttagcctggatttccacccctatcccccatgggctgacctcagccccgccctacacagggaggtggctgacacagggtcctgtcttgaatgccagctccttccctggctgaagctgagtatttaggtcaggctggtcagtgagtatgatgctatgtctgctattaatctctactaaaactgtaagtgcagcgtcactcttattatttcaggatccatctgtgtttcccatgcgttgcgaaggaaagctgagctgtcagcctggctgaaatgccgcgtggagttgggagtct

SEQ ID NO: 73227 - DNA, 1865 bp, Homo sapiens
cttataaggatactcatacttgttggatgttggaattgccctaaatccaggataatctcatattgagatccttaacctaagtacatctgcaacgaccctataaggtcccattcacaggtactggtgacctgacacatcttttcggaggaccctactgaatctactgcatcccttgagtagtcatctgtgatgtgtacttaccccgatggaaagtagacgtccccatcagtgctaaccgtggtcatagcagtggtggttggtccatgagagaaacagctcaggcagggtgcagtctggtctttgtggccctctaataggctgattgggacatttcttattctcttaccccaagtgaaagcccctcagggaaaaaaccagaagtcctttgtcttcatcctggagcccaagcagcagggcgatcctccggtggagtttgccacagacagggtggaggagctctttgagtggtttcagagcatccgagagatcacctggaagattgacaccaaggagaacaacatgaagtactgggagaagaaccagtccatcgccatcgagctctctgacctggttgtctactgcaaaccaaccagcaaaaccaaggacaacttagaaaatcctgacttccgagaaatccgctcctttgtggagacgaaggctgacagcatcatcagacagaagcccgtcgacctcctgaagtacaatcaaaagggcctgacccgcgtctacccaaagggacaaagagttgactcttcaaactacgaccccttccgcctctggctgtgcggttctcagatggtggcactcaatttccagacggcagataagtacatgcagatgaatcacgcattgttttctctcaacgggcgcacgggctacgttctgcagcctgagagcatgaggacagagaaatatgacccgatgccacccgagtcccagaggaagatcctgatgacgctgacagtcaaggttctcggtgctcgccatctccccaaacttggacgaagtattgcctgtccctttgtagaagtggagatctgtggagccgagtatgacaacaacaagttcaagacgacggttgtgaatgataatggcctcagccctatctgggctccaacacaggagaaggtgacatttgaaatttatgacccaaacctggcatttctgcgctttgtggtttatgaagaagatatgttcagcgatcccaactttcttgctcatgccacttaccccattaaagcagtcaaatcaggattcaggtccgttcctctgaagaatgggtacagcgaggacatagagctggcttccctcctggttttctgtgagatgcggccagtcctggagagcgaagaggaactttactcctcctgtcgccagctgaggaggcggcaagaagaactgaacaaccagctctttctgtatgacacacaccagaacttgcgcaatgccaaccgggatgccctggttaaagagttcagtgttaatgagaaccagctccagctgtaccaggagaaatgcaacaagaggttaagagagaagagagtcagcaacagcaagttttactcatagaagctggggtatgtgtgtaagggtattgtgtgtgtgcgcatgtgtgtttgcatgtaggagaacgtgccctattcacactctgggaagacgctaatctgtgacatcttttcttcaagcctgccatcaaggacatttcttaagacccaactggcatgagttggggtaatttcctattattttcatcttggacaactttcttaacttatattctttatagaggattccccaaaatgtgctcctcatttttggcctctcatgttccaaacctcattgaataaaagcaatgaaaaccttga

SEQ ID NO: 73228 - DNA, 1525 bp, Homo sapiens
ggatggtgatagtttaaaaaaaaaagtaaattacagtaattctagcctaaaaggtggtgggaaaactaggcccctttttaatacttggaacccccagagggcaagagtccacagtgataccaattgggacaatatcatcagaaccccttgaatgtcaaagagggagattcctggtttccttttataatctgagcatccagccattgcagcaaacattaagaaaatgcacagatgagacacagaagtactgatgacctttttctctgtgtgcagaaaatcctgacttccgagaaatccgctcctttgtggagacgaaggctgacagcatcatcagacagaagcccgtcgacctcctgaagtacaatcaaaagggcctgacccgcgtctacccaaagggacaaagagttgactcttcaaactacgaccccttccgcctctggctgtgcggttctcagatggtggcactcaatttccagacggcagataagtacatgcagatgaatcacgcattgttttctctcaacgggcgcacgggctacgttctgcagcctgagagcatgaggacagagaaatatgacccgatgccacccgagtcccagaggaagatcctgatgacgctgacagtcaaggttctcggtgctcgccatctccccaaacttggacgaagtattgcctgtccctttgtagaagtggagatctgtggagccgagtatgacaacaacaagttcaagacgacggttgtgaatgataatggcctcagccctatctgggctccaacacaggagaaggtgacatttgaaatttatgacccaaacctggcatttctgcgctttgtggtttatgaagaagatatgttcagcgatcccaactttcttgctcatgccacttaccccattaaagcagtcaaatcaggattcaggtccgttcctctgaagaatgggtacagcgaggacatagagctggcttccctcctggttttctgtgagatgcggccagtcctggagagcgaagaggaactttactcctcctgtcgccagctgaggaggcggcaagaagaactgaacaaccagctctttctgtatgacacacaccagaacttgcgcaatgccaaccgggatgccctggttaaagagttcagtgttaatgagaaccagctccagctgtaccaggagaaatgcaacaagaggttaagagagaagagagtcagcaacagcaagttttactcatagaagctggggtatgtgtgtaagggtattgtgtgtgtgcgcatgtgtgtttgcatgtaggagaacgtgccctattcacactctgggaagacgctaatctgtgacatcttttcttcaagcctgccatcaaggacatttcttaagacccaactggcatgagttggggtaatttcctattattttcatcttggacaactttcttaacttatattctttatagaggattccccaaaatgtgctcctcatttttggcctctcatgttccaaacctcattgaataaaagcaatgaaaaccttga

SEQ ID NO: 73229 - DNA, 972 bp, Homo sapiens
tggaaatccagtgattaagctctgccttgatcagaggcacctgcttgggcatggatgtgtgcattcatgagctcaggttctcggtgctcgccatctccccaaacttggacgaagtattgcctgtccctttgtagaagtggagatctgtggagccgagtatgacaacaacaagttcaagacgacggttgtgaatgataatggcctcagccctatctgggctccaacacaggagaaggtgacatttgaaatttatgacccaaacctggcatttctgcgctttgtggtttatgaagaagatatgttcagcgatcccaactttcttgctcatgccacttaccccattaaagcagtcaaatcaggattcaggtccgttcctctgaagaatgggtacagcgaggacatagagctggcttccctcctggttttctgtgagatgcggccagtcctggagagcgaagaggaactttactcctcctgtcgccagctgaggaggcggcaagaagaactgaacaaccagctctttctgtatgacacacaccagaacttgcgcaatgccaaccgggatgccctggttaaagagttcagtgttaatgagaaccagctccagctgtaccaggagaaatgcaacaagaggttaagagagaagagagtcagcaacagcaagttttactcatagaagctggggtatgtgtgtaagggtattgtgtgtgtgcgcatgtgtgtttgcatgtaggagaacgtgccctattcacactctgggaagacgctaatctgtgacatcttttcttcaagcctgccatcaaggacatttcttaagacccaactggcatgagttggggtaatttcctattattttcatcttggacaactttcttaacttatattctttatagaggattccccaaaatgtgctcctcatttttggcctctcatgttccaaacctcattgaataaaagcaatgaaaaccttga

SEQ ID NO: 73230 - DNA, 3479 bp, Homo sapiens
  misc_feature (887)..(887): n is a, c, g, or t
  misc_feature (1305)..(1305): n is a, c, g, or t
  misc_feature (1344)..(1344): n is a, c, g, or t
  misc_feature (1653)..(1653): n is a, c, g, or t
ggcacgaggcggcgctgagtgacccgagtcgggacgcgggctgcgcgcgcgggaccccggagcccaaacccggggcaggcgggcagctgtgcccgggcggcacggccagcttcctgatttctcccgattccttccttctccctggagcggccgacaatgtccaccacggtcaatgtagattcccttgcggaatatgagaagagccagatcaagagagccctggagctggggacggtgatgactgtgttcagcttccgcaagtccacccccgagcggagaaccgtccaggtgatcatggagacgcggcaggtggcctggagcaagaccgccgacaagatcgagggcttcttggatatcatggaaataaaagaaatccgcccagggaagaactccaaagatttcgagcgagcaaaagcagttcgccagaaagaagactgctgcttcaccatcctatatggcactcagttcgtcctcagcacgctcagcttggcagctgactctaaagaggatgcagttaactggctctctggcttgaaaatcttacaccaggaagcgatgaatgcgtccacgcccaccattatcgagagttggctgagaaagcagatatattctgtggatcaaaccagaagaaacagcatcagtctccgagagttgaagaccatcttgcccctgatcaactttaaagtgagcagtgccaagttccttaaagataagtttgtggaaataggagcacacaaagatgagctcagctttgaacagttccatctcttctataaaaaacttatgtttgaacagcaaaaatcgattctcgatgaattcaaaaaggattcgtccgtgttcatcctggggaacactgacaggccggatgcctctgctgtttacctgcntgacttccagaggtttctcatacatgaacagcaggagcattgggctcaggatctgaacaaagtccgtgagcggatgacaaagttcattgatgacaccatgcgtgaaactgctgagcctttcttgtttgtggatgagttcctcacgtacctgttttcacgagaaaacagcatctgggatgagaagtatgacgcggtggacatgcaggacatgaacaaccccctgtctcattactggatctcctcgtcacataacacgtaccttacaggtgaccagctgcggagcgagtcgtccccagaagcttacatccgctgcctgcgcatgggctgtcgctgcattgaactggactgctgggacgggcccgatgggaagccggtcatctaccatggctggacgcggactaccaagatcaagtttgangacgtcgtgcaggccatcaaagaccacgcctttgttacntcgagcttcccagtgatcctgtccatcgaggagcactgcagcgtggagcaacagcgtcacatggccaaggccttcaaggaagtatttggcgacctgctgttgacgaagcccacggaggccagtgctgaccagctgccctcgcccagccagctgcgggagaagatcatcatcaagcataagaagctgggcccccgaggcgatgtggatgtcaacatggaggacaagaaggacgaacacaagcaacagggggagctgtacatgtgggattccattgaccagaaatggactcggcactactgcgccattgcngatgccaagctgtccttcagtgatgacattgaacagactatggaggaggaagtgccccaggatataccccctacagaactacattttggggagaaatggttccacaagaaggtggagaagaggacgagtgccgagaagttgctgcaggaatactgcatggagacggggggcaaggatggcaccttcctggttcgggagagcgagaccttccccaatgactacaccctgtccttctggcggtcaggccgggtccagcactgccggatccgctccaccatggagggcgggaccctgaaatactacttgactgacaacctcaccttcagcagcatctatgccctcatccagcactaccgcgagacgcacctgcgctgcgccgagttcgagctgcggctcacggaccctgtgcccaaccccaacccccacgagtccaagccgtggtactatgacagcctgagccgcggagaggcagaggacatgctgatgaggattccccgggacggggccttcctgatccggaagcgagaggggagcgactcctatgccatcaccttcagggctaggggcaaggtaaagcattgtcgcatcaaccgggacggccggcactttgtgctggggacctccgcctattttgagagtctggtggagctcgtcagttactacgagaagcattcactctaccgaaagatgagactgcgctaccccgtgacccccgagctcctggagcgctacaatatggaaagagatataaactccctctacgacgtcagcagaatgtatgtggatcccagtgaaatcaatccgtccatgcctcagagaaccgtgaaagctctgtatgactacaaagccaagcgaagcgatgagctgagcttctgccgtggtgccctcatccacaatgtctccaaggagcccgggggctggtggaaaggagactatggaaccaggatccagcagtacttcccatccaactacgtcgaggacatctcaactgcagacttcgaggagctagaaaagcagattattgaagacaatcccttagggtctctttgcagaggaatattggacctcaatacctataacgtcgtgaaagcccctcagggaaaaaaccagaagtcctttgtcttcatcctggagcccaagcagcagggcgatcctccggtggagtttgccacagacagggtggaggagctctttgagtggtttcagagcatccgagagatcacctggaagattgacaccaaggagaacaacatgaagtactgggagaagaaccagtccatcgccatcgagctctctgacctggttgtctactgcaaaccaaccagcaaaaccaaggacaacttagaaaatcctgacttccgagaaatccgctcctttgtggagacgaaggctgacagcatcatcagacagaagcccgtcgacctcctgaagtacaatcaaaaggggacaaagagttgactcttcaaactacgaccccttccgcctctggctgtgcggttctcagatggtggcactcaatttccagacggcagataagtacatgcagatgaatcacgcattgttttctctcaacgggcgcacgggctacgttctgcagcctgagagcatgaggacagagaaatatgacccgatgccacccgagtcccagaggaagatcctgatgacgctgacagtcaagtctcgggtgctcgccatcttccccaacttgggccgacctcattgcctgtccctttgctcaacgtggcgcctctgcggcgcccggctatgacaaccaccgctccagcagcacgccgccggcctcgcatgcgcccgagcctatctgggca

SEQ ID NO: 73231 - DNA, 3622 bp, Homo sapiens
  misc_feature (887)..(887): n is a, c, g, or t
  misc_feature (1305)..(1305): n is a, c, g, or t
  misc_feature (1344)..(1344): n is a, c, g, or t
  misc_feature (1653)..(1653): n is a, c, g, or t
  misc_feature (2900)..(2900): n is a, c, g, or t
  misc_feature (3239)..(3239): n is a, c, g, or t
  misc_feature (3442)..(3442): n is a, c, g, or t
ggcacgaggcggcgctgagtgacccgagtcgggacgcgggctgcgcgcgcgggaccccggagcccaaacccggggcaggcgggcagctgtgcccgggcggcacggccagcttcctgatttctcccgattccttccttctccctggagcggccgacaatgtccaccacggtcaatgtagattcccttgcggaatatgagaagagccagatcaagagagccctggagctggggacggtgatgactgtgttcagcttccgcaagtccacccccgagcggagaaccgtccaggtgatcatggagacgcggcaggtggcctggagcaagaccgccgacaagatcgagggcttcttggatatcatggaaataaaagaaatccgcccagggaagaactccaaagatttcgagcgagcaaaagcagttcgccagaaagaagactgctgcttcaccatcctatatggcactcagttcgtcctcagcacgctcagcttggcagctgactctaaagaggatgcagttaactggctctctggcttgaaaatcttacaccaggaagcgatgaatgcgtccacgcccaccattatcgagagttggctgagaaagcagatatattctgtggatcaaaccagaagaaacagcatcagtctccgagagttgaagaccatcttgcccctgatcaactttaaagtgagcagtgccaagttccttaaagataagtttgtggaaataggagcacacaaagatgagctcagctttgaacagttccatctcttctataaaaaacttatgtttgaacagcaaaaatcgattctcgatgaattcaaaaaggattcgtccgtgttcatcctggggaacactgacaggccggatgcctctgctgtttacctgcntgacttccagaggtttctcatacatgaacagcaggagcattgggctcaggatctgaacaaagtccgtgagcggatgacaaagttcattgatgacaccatgcgtgaaactgctgagcctttcttgtttgtggatgagttcctcacgtacctgttttcacgagaaaacagcatctgggatgagaagtatgacgcggtggacatgcaggacatgaacaaccccctgtctcattactggatctcctcgtcacataacacgtaccttacaggtgaccagctgcggagcgagtcgtccccagaagcttacatccgctgcctgcgcatgggctgtcgctgcattgaactggactgctgggacgggcccgatgggaagccggtcatctaccatggctggacgcggactaccaagatcaagtttgangacgtcgtgcaggccatcaaagaccacgcctttgttacntcgagcttcccagtgatcctgtccatcgaggagcactgcagcgtggagcaacagcgtcacatggccaaggccttcaaggaagtatttggcgacctgctgttgacgaagcccacggaggccagtgctgaccagctgccctcgcccagccagctgcgggagaagatcatcatcaagcataagaagctgggcccccgaggcgatgtggatgtcaacatggaggacaagaaggacgaacacaagcaacagggggagctgtacatgtgggattccattgaccagaaatggactcggcactactgcgccattgcngatgccaagctgtccttcagtgatgacattgaacagactatggaggaggaagtgccccaggatataccccctacagaactacattttggggagaaatggttccacaagaaggtggagaagaggacgagtgccgagaagttgctgcaggaatactgcatggagacggggggcaaggatggcaccttcctggttcgggagagcgagaccttccccaatgactacaccctgtccttctggcggtcaggccgggtccagcactgccggatccgctccaccatggagggcgggaccctgaaatactacttgactgacaacctcaccttcagcagcatctatgccctcatccagcactaccgcgagacgcacctgcgctgcgccgagttcgagctgcggctcacggaccctgtgcccaaccccaacccccacgagtccaagccgtggtactatgacagcctgagccgcggagaggcagaggacatgctgatgaggattccccgggacggggccttcctgatccggaagcgagaggggagcgactcctatgccatcaccttcagggctaggggcaaggtaaagcattgtcgcatcaaccgggacggccggcactttgtgctggggacctccgcctattttgagagtctggtggagctcgtcagttactacgagaagcattcactctaccgaaagatgagactgcgctaccccgtgacccccgagctcctggagcgctacaatatggaaagagatataaactccctctacgacgtcagcagaatgtatgtggatcccagtgaaatcaatccgtccatgcctcagagaaccgtgaaagctctgtatgactacaaagccaagcgaagcgatgagctgagcttctgccgtggtgccctcatccacaatgtctccaaggagcccgggggctggtggaaaggagactatggaaccaggatccagcagtacttcccatccaactacgtcgaggacatctcaactgcagacttcgaggagctagaaaagcagattattgaagacaatcccttagggtctctttgcagaggaatattggacctcaatacctataacgtcgtgaaagcccctcagggaaaaaaccagaagtcctttgtcttcatcctggagcccaagcagcagggcgatcctccggtggagtttgccacagacagggtggaggagctctttagaaagtggttatccaagagcaatcccgagaagggaatttcgacgcctggganagggaaactttgggaacgaaccgaaagggaaggaaaaccaaaaccgaaatttgggaacaacggggttaaacctgggggggggaaaggcaaaaaagggaaaacccaaggggttaccgccaattccggggcccccccaaaattccgggaaggggccccatttatccccgagtttgtccccttttaggggaaaaagccgccccagtttggggggggggtattatatatggggttccgattaaaaaaccccgtttgggcccaaataaatagataaaaaagccccgccccgaaaaaaaagcccccaaatggtccgaaaaagacccagatgtggagcaaaacctntaaaaaaggggggggaaaaccagaagctagagtcccgttggaaaccccctttttttatccccccggggaaagggtaaacaaaaaaatgtttcccccccgtggggcctgttttccccctttatttattgcttaggggcgggaaaccgggacaaccccggaaaaaagcgggcctttgaaccagcgattccattccagagccaganagccccccgggggttttccccgggaaacacaccgcccatttttcccccccgtttgggaaaaatggtttaaacccaaaaattccgcacaaaaacacgggggaccaaaacggaagttatgactctgtcaaaactaaacaggaacccccccttttttacccggggcgcccattaccttagggc

SEQ ID NO: 73232 - DNA, 564 bp, Homo sapiens
gcatgagcaagaaagttgggatcgctgaacatatcttcttcataaaccacaaggcgcagaaatgcaacaagaggttaagagagaagagagtcagcaacagcaagttttactcatagaagctggggtatgtgtgtaagggtattgtgtgtgtgcgcatgtgtgtttgcatgtaggagaacgtgccctattcacactctgggaagacgctaatctgtgacatcttttcttcaagcctgccatcaaggacatttcttaagacccaactggcatgagttggggtaatttcctattattttcatcttggacaactttcttaacttatattctttatagaggattccccaaaatgtgctcctcatttttggcctctcatgttccaaacctcattgaataaaagcaatgaaaaccttgatcaattaagccttctgttgcacgacctgtgcagtgaacaggatttcttttctggccaagaagattctacctctaatgatccaggtaactgatgtccatggaggatgagctggaaatgtaagaaactattcatgagactctgaaaaaaaaaaa

SEQ ID NO: 73233 - DNA, 529 bp, Homo sapiens
gaccgagctcgatacctgaacattcgtgtcccacaagagttaagagagaagagagtcagcaacagcaagttttactcatagaagctggggtatgtgtgtaagggtattgtgtgtgtgcgcatgtgtgtttgcatgtaggagaacgtgccctattcacactctgggaagacgctaatctgtgacatcttttcttcaagcctgccatcaaggacatttcttaagacccaactggcatgagttggggtaatttcctattattttcatcttggacaactttcttaacttatattctttatagaggattccccaaaatgtgctcctcatttttggcctctcatgttccaaacctcattgaataaaagcaatgaaaaccttgatcaattaagccttctgttgcacgacctgtgcagtgaacaggatttcttttctggccaagaagattctacctctaatgatccaggtaactgatgtccatggaggatgagctggaaatgtaagaaactattcatgagactctgaaaaaaaaaaa

SEQ ID NO: 73234 - DNA, 530 bp, Homo sapiens
ggtgtttgagatcagaaagaaggagaaatgcaacaagaggttaagagagaagagagtcagcaacagcaagttttactcatagaagctggggtatgtgtgtaagggtattgtgtgtgtgcgcatgtgtgtttgcatgtaggagaacgtgccctattcacactctgggaagacgctaatctgtgacatcttttcttcaagcctgccatcaaggacatttcttaagacccaactggcatgagttggggtaatttcctattattttcatcttggacaactttcttaacttatattctttatagaggattccccaaaatgtgctcctcatttttggcctctcatgttccaaacctcattgaataaaagcaatgaaaaccttgatcaattaagccttctgttgcacgacctgtgcagtgaacaggatttcttttctggccaagaagattctacctctaatgatccaggtaactgatgtccatggaggatgagctggaaatgtaagaaactattcatgagactctgaaaaaaaaaaa

SEQ ID NO: 73235 - DNA, 1007 bp, Homo sapiens
ttgagtatccccgtgatcctgcaatgctagagccctgatgggcagtcagagctggggagcaggtgtgcaggttttgagggtgcaggggatagagagttatgacgaggatgctggggtccacagagcccccgaggatttgaagaactagaatttgagacactctaacagtgtggctttaggggaggggacaggaggcagagttaaagacagaggggtggtgacagagaagagcccccttccatcctgacctcacctatatttgagggctgtggccaggactgagctgcacaccaaaacctcgtggaaacagctttgtcgagaattttcacagtgagaggaagaaacgagaggggcagggttgtcttcaggaaaggaaaacattcaaccatattaaagatccgagtgtgcaagaaagcaaagtggggatggaggaggaaaaatgcagggcgagctgggaagatgggatttctcgggggcgggcactaaagacagtgaactccaaacaggagaacaacatgaagtactgggagaagaaccagtccatcgccatcgagctctctgacctggttgtctactgcaaaccaaccagcaaaaccaaggacaacttaggtaacatctttcccaagaacatgccctataactccaatgaaaacttaacttcctttagagtctgatattttcagagggggcagagagtgcattctctcattcttaactactcccagtagatggccccaccttgggtttgtcctccgagtgagggagctggtggcagaagcttttttggtgtattagtccattttcatgctgctgataaagacatacccaagactgagtaatttataaggaaaaagaggtttaatggactcacagttccacgtggaggaggcctcacaattatggcagcagaggagagagaatgagaagcaagtgaaaggggaaacccttataaaaccatcagatctcgcgagacttattcagtaccacaacaacggtacaggggaaac

SEQ ID NO: 73236 - DNA, 1333 bp, Homo sapiens
atttgaattaaaattgcctatgcaatttattgctacatagacacttttagcaagtttgaatcttttcttttatgattcgggatttggtgacatacttggaaaggtgttccccagtctgggagtttgctgtctagaaaccctatattttctttgagtgagatacctatttgaacagctgcctcacattaatttggggaaaaggtgaaattcattccccacctagaaactcctggcctagggggccagcgtgctcatgcctgacttacagcaggcgttcactttccttcccagataagtacatgcagatgaatcacgcattgttttctctcaacgggcgcacgggctacgttctgcagcctgagagcatgaggacagagaaatatgacccgatgccacccgagtcccagaggaagatcctgatgacgctgacagtcaaggttctcggtgctcgccatctccccaaacttggacgaagtattgcctgtccctttgtagaagtggagatctgtggagccgagtatgacaacaacaagttcaagacgacggttgtgaatgataatggcctcagccctatctgggctccaacacaggagaaggtgacatttgaaatttatgacccaaacctggcatttctgcgctttgtggtttatgaagaagatatgttcagcgatcccaactttcttgctcatgccacttaccccattaaagcagtcaaatcaggattcaggtccgttcctctgaagaatgggtacagcgaggacatagagctggcttccctcctggttttctgtgagatgcggccagtcctggagagcgaagaggaactttactcctcctgtcgccagctgaggaggcggcaagaagaactgaacaaccagctctttctgtatgacacacaccagaacttgcgcaatgccaaccgggatgccctggttaaagagttcagtgttaatgagaaccagctccagctgtaccaggagaaatgcaacaagaggttaagagagaagagagtcagcaacagcaagttttactcatagaagctggggtatgtgtgtaagggtattgtgtgtgtgcgcatgtgtgtttgcatgtaggagaacgtgccctattcacactctgggaagacgctaatctgtgacatcttttcttcaagcctgccatcaaggacatttcttaagacccaactggcatgagttggggtaatttcctattattttcatcttggacaactttcttaacttatattctttatagaggattccccaaaatgtgctcctcatttttggcctctcatgttccaaacctcattgaataaaagcaatgaaaaccttga

SEQ ID NO: 73237 - DNA, 4402 bp, Homo sapiens
  misc_feature (887)..(887): n is a, c, g, or t
  misc_feature (1305)..(1305): n is a, c, g, or t
  misc_feature (1344)..(1344): n is a, c, g, or t
  misc_feature (1653)..(1653): n is a, c, g, or t
ggcacgaggcggcgctgagtgacccgagtcgggacgcgggctgcgcgcgcgggaccccggagcccaaacccggggcaggcgggcagctgtgcccgggcggcacggccagcttcctgatttctcccgattccttccttctccctggagcggccgacaatgtccaccacggtcaatgtagattcccttgcggaatatgagaagagccagatcaagagagccctggagctggggacggtgatgactgtgttcagcttccgcaagtccacccccgagcggagaaccgtccaggtgatcatggagacgcggcaggtggcctggagcaagaccgccgacaagatcgagggcttcttggatatcatggaaataaaagaaatccgcccagggaagaactccaaagatttcgagcgagcaaaagcagttcgccagaaagaagactgctgcttcaccatcctatatggcactcagttcgtcctcagcacgctcagcttggcagctgactctaaagaggatgcagttaactggctctctggcttgaaaatcttacaccaggaagcgatgaatgcgtccacgcccaccattatcgagagttggctgagaaagcagatatattctgtggatcaaaccagaagaaacagcatcagtctccgagagttgaagaccatcttgcccctgatcaactttaaagtgagcagtgccaagttccttaaagataagtttgtggaaataggagcacacaaagatgagctcagctttgaacagttccatctcttctataaaaaacttatgtttgaacagcaaaaatcgattctcgatgaattcaaaaaggattcgtccgtgttcatcctggggaacactgacaggccggatgcctctgctgtttacctgcntgacttccagaggtttctcatacatgaacagcaggagcattgggctcaggatctgaacaaagtccgtgagcggatgacaaagttcattgatgacaccatgcgtgaaactgctgagcctttcttgtttgtggatgagttcctcacgtacctgttttcacgagaaaacagcatctgggatgagaagtatgacgcggtggacatgcaggacatgaacaaccccctgtctcattactggatctcctcgtcacataacacgtaccttacaggtgaccagctgcggagcgagtcgtccccagaagcttacatccgctgcctgcgcatgggctgtcgctgcattgaactggactgctgggacgggcccgatgggaagccggtcatctaccatggctggacgcggactaccaagatcaagtttgangacgtcgtgcaggccatcaaagaccacgcctttgttacntcgagcttcccagtgatcctgtccatcgaggagcactgcagcgtggagcaacagcgtcacatggccaaggccttcaaggaagtatttggcgacctgctgttgacgaagcccacggaggccagtgctgaccagctgccctcgcccagccagctgcgggagaagatcatcatcaagcataagaagctgggcccccgaggcgatgtggatgtcaacatggaggacaagaaggacgaacacaagcaacagggggagctgtacatgtgggattccattgaccagaaatggactcggcactactgcgccattgcngatgccaagctgtccttcagtgatgacattgaacagactatggaggaggaagtgccccaggatataccccctacagaactacattttggggagaaatggttccacaagaaggtggagaagaggacgagtgccgagaagttgctgcaggaatactgcatggagacggggggcaaggatggcaccttcctggttcgggagagcgagaccttccccaatgactacaccctgtccttctggcggtcaggccgggtccagcactgccggatccgctccaccatggagggcgggaccctgaaatactacttgactgacaacctcaccttcagcagcatctatgccctcatccagcactaccgcgagacgcacctgcgctgcgccgagttcgagctgcggctcacggaccctgtgcccaaccccaacccccacgagtccaagccgtggtactatgacagcctgagccgcggagaggcagaggacatgctgatgaggattccccgggacggggccttcctgatccggaagcgagaggggagcgactcctatgccatcaccttcagggctaggggcaaggtaaagcattgtcgcatcaaccgggacggccggcactttgtgctggggacctccgcctattttgagagtctggtggagctcgtcagttactacgagaagcattcactctaccgaaagatgagactgcgctaccccgtgacccccgagctcctggagcgctacaatatggaaagagatataaactccctctacgacgtcagcagaatgtatgtggatcccagtgaaatcaatccgtccatgcctcagagaaccgtgaaagctctgtatgactacaaagccaagcgaagcgatgagctgagcttctgccgtggtgccctcatccacaatgtctccaaggagcccgggggctggtggaaaggagactatggaaccaggatccagcagtacttcccatccaactacgtcgaggacatctcaactgcagacttcgaggagctagaaaagcagattattgaagacaatcccttagggtctctttgcagaggaatattggacctcaatacctataacgtcgtgaaagcccctcagggaaaaaaccagaagtcctttgtcttcatcctggagcccaagcagcagggcgatcctccggtggagtttgccacagacagggtggaggagctctttgagtggtttcagagcatccgagagatcacctggaagattgacaccaaggagaacaacatgaagtactgggagaagaaccagtccatcgccatcgagctctctgacctggttgtctactgcaaaccaaccagcaaaaccaaggacaacttagaaaatcctgacttccgagaaatccgctcctttgtggagacgaaggctgacagcatcatcagacagaagcccgtcgacctcctgaagtacaatcaaaagggcctgacccgcgtctacccaaagggacaaagagttgactcttcaaactacgaccccttccgcctctggctgtgcggttctcagatggtggcactcaatttccagacggcagataagtacatgcagatgaatcacgcattgttttctctcaacgggcgcacgggctacgttctgcagcctgagagcatgaggacagagaaatatgacccgatgccacccgagtcccagaggaagatcctgatgacgctgacagtcaaggttctcggtgctcgccatctccccaaacttggacgaagtattgcctgtccctttgtagaagtggagatctgtggagccgagtatgacaacaacaagttcaagacgacggttgtgaatgataatggcctcagccctatctgggctccaacacaggagaaggtgacatttgaaatttatgacccaaacctggcatttctgcgctttgtggtttatgaagaagatatgttcagcgatcccaactttcttgctcatgccacttaccccattaaagcagtcaaatcaggattcaggtccgttcctctgaagaatgggtacagcgaggacatagagctggcttccctcctggttttctgtgagatgcggccagtcctggagagcgaagaggaactttactcctcctgtcgccagctgaggaggcggcaagaagaactgaacaaccagctctttctgtatgacacacaccagaacttgcgcaatgccaaccgggatgccctggttaaagagttcagtgttaatgagaaccagctccagctgtaccaggagaaatgcaacaagaggttaagagagaagagagtcagcaacagcaagttttactcatagaagctggggtatgtgtgtaagggtattgtgtgtgtgcgcatgtgtgtttgcatgtaggagaacgtgccctattcacactctgggaagacgctaatctgtgacatcttttcttcaagcctgccatcaaggacatttcttaagacccaactggcatgagttggggtaatttcctattattttcatcttggacaactttcttaacttatattctttatagaggattccccaaaatgtgctcctcatttttggcctctcatgttccaaacctcattgaataaaagcaatgaaaaccttgatcaattaagccttctgttgcacgacctgtgcagtgaacaggatttcttttctggccaagaagattctacctctaatgatccaggtaactgatgtccatggaggatgagctggaaatgtaagaaactattcatgagactctgaaaaaaaaaaa

SEQ ID NO: 73238 - DNA, 3730 bp, Homo sapiens
  misc_feature (887)..(887): n is a, c, g, or t
  misc_feature (1305)..(1305): n is a, c, g, or t
  misc_feature (1344)..(1344): n is a, c, g, or t
  misc_feature (1653)..(1653): n is a, c, g, or t
ggcacgaggcggcgctgagtgacccgagtcgggacgcgggctgcgcgcgcgggaccccggagcccaaacccggggcaggcgggcagctgtgcccgggcggcacggccagcttcctgatttctcccgattccttccttctccctggagcggccgacaatgtccaccacggtcaatgtagattcccttgcggaatatgagaagagccagatcaagagagccctggagctggggacggtgatgactgtgttcagcttccgcaagtccacccccgagcggagaaccgtccaggtgatcatggagacgcggcaggtggcctggagcaagaccgccgacaagatcgagggcttcttggatatcatggaaataaaagaaatccgcccagggaagaactccaaagatttcgagcgagcaaaagcagttcgccagaaagaagactgctgcttcaccatcctatatggcactcagttcgtcctcagcacgctcagcttggcagctgactctaaagaggatgcagttaactggctctctggcttgaaaatcttacaccaggaagcgatgaatgcgtccacgcccaccattatcgagagttggctgagaaagcagatatattctgtggatcaaaccagaagaaacagcatcagtctccgagagttgaagaccatcttgcccctgatcaactttaaagtgagcagtgccaagttccttaaagataagtttgtggaaataggagcacacaaagatgagctcagctttgaacagttccatctcttctataaaaaacttatgtttgaacagcaaaaatcgattctcgatgaattcaaaaaggattcgtccgtgttcatcctggggaacactgacaggccggatgcctctgctgtttacctgcntgacttccagaggtttctcatacatgaacagcaggagcattgggctcaggatctgaacaaagtccgtgagcggatgacaaagttcattgatgacaccatgcgtgaaactgctgagcctttcttgtttgtggatgagttcctcacgtacctgttttcacgagaaaacagcatctgggatgagaagtatgacgcggtggacatgcaggacatgaacaaccccctgtctcattactggatctcctcgtcacataacacgtaccttacaggtgaccagctgcggagcgagtcgtccccagaagcttacatccgctgcctgcgcatgggctgtcgctgcattgaactggactgctgggacgggcccgatgggaagccggtcatctaccatggctggacgcggactaccaagatcaagtttgangacgtcgtgcaggccatcaaagaccacgcctttgttacntcgagcttcccagtgatcctgtccatcgaggagcactgcagcgtggagcaacagcgtcacatggccaaggccttcaaggaagtatttggcgacctgctgttgacgaagcccacggaggccagtgctgaccagctgccctcgcccagccagctgcgggagaagatcatcatcaagcataagaagctgggcccccgaggcgatgtggatgtcaacatggaggacaagaaggacgaacacaagcaacagggggagctgtacatgtgggattccattgaccagaaatggactcggcactactgcgccattgcngatgccaagctgtccttcagtgatgacattgaacagactatggaggaggaagtgccccaggatataccccctacagaactacattttggggagaaatggttccacaagaaggtggagaagaggacgagtgccgagaagttgctgcaggaatactgcatggagacggggggcaaggatggcaccttcctggttcgggagagcgagaccttccccaatgactacaccctgtccttctggcggtcaggccgggtccagcactgccggatccgctccaccatggagggcgggaccctgaaatactacttgactgacaacctcaccttcagcagcatctatgccctcatccagcactaccgcgagacgcacctgcgctgcgccgagttcgagctgcggctcacggaccctgtgcccaaccccaacccccacgagtccaagccgtggtactatgacagcctgagccgcggagaggcagaggacatgctgatgaggattccccgggacggggccttcctgatccggaagcgagaggggagcgactcctatgccatcaccttcagggctaggggcaaggtaaagcattgtcgcatcaaccgggacggccggcactttgtgctggggacctccgcctattttgagagtctggtggagctcgtcagttactacgagaagcattcactctaccgaaagatgagactgcgctaccccgtgacccccgagctcctggagcgctacaatatggaaagagatataaactccctctacgacgtcagcagaatgtatgtggatcccagtgaaatcaatccgtccatgcctcagagaaccgtgaaagctctgtatgactacaaagccaagcgaagcgatgagctgagcttctgccgtggtgccctcatccacaatgtctccaaggagcccgggggctggtggaaaggagactatggaaccaggatccagcagtacttcccatccaactacgtcgaggacatctcaactgcagacttcgaggagctagaaaagcagattattgaagacaatcccttagggtctctttgcagaggaatattggacctcaatacctataacgtcgtgaaagcccctcagggaaaaaaccagaagtcctttgtcttcatcctggagcccaagcagcagggcgatcctccggtggagtttgccacagacagggtggaggagctctttgagtggtttcagagcatccgagagatcacctggaagattgacaccaaggagaacaacatgaagtactgggagaagaaccagtccatcgccatcgagctctctgacctggttgtctactgcaaaccaaccagcaaaaccaaggacaacttagaaaatcctgacttccgagaaatccgctcctttgtggagacgaaggctgacagcatcatcagacagaagcccgtcgacctcctgaagtacaatcaaaagggcctgacccgcgtctacccaaagggacaaagagttgactcttcaaactacgaccccttccgcctctggctgtgcggttctcagatggtggcactcaatttccagacggcaggtaaaggccgactgaaggtagtcccgtccctgcaaggtggcggttgcagtcactccaggccgagtcaccttgggtcagcgataccatgtggtgtccaagaatgagtgatttgtccgagggactgcacggttcagcagagtaatggttagtatgaggtccagcagctgaatggagggatgagaggaccgaaggctgcttggcttaggcaggcttcgtgattgtaagtaagtgacagaggctgagttagtctggcttagaaaaagaaaatgcattagttcatgtaattaaagcatctttggagttctcttctccaggcctgttgctgtgtgagggctttctgctcagactttcttccagagacatttacatgctggcataactaacatacacaaacttctggacacaaagtgatcgcataaatcatggggctttgtgcttttgttgttgttatttaagacctctttcgagggatctattcatcagtagcgtcctttacattctttttatagccacatcggattc

SEQ ID NO: 73239 - DNA, 712 bp, Homo sapiens
ctgcctcggcctcccaagtgctgggattacaggcgtgagccactgtgcctagcctagatgttttttactagttaaaatgggatttttctttttaattcttcctcaaaatgtaaaatcaagataagtttgctataaaaattaaaggagataaaatttaaaagaattaaaaatagtttgttaggttgtctttccttcaagttatgtttttttgttttttttgtttttttgagatagagccagaccctgtctcaacaacaacaacaacaacaacaacaacaacaacaaagtatgaccactcaaggctaagcaggacggaatataactttacactcctgaagtttaatagattctgggttactccttctaagtagcagaaaccaatgagtaaagatatcaagtcaagaggttaaataagcaaaacaacaataacagaattaaaaagaaaatggttttattacacaattaaacttgaatgtgacatgcatcagtcaatctgcttaagagactgcaaagatagaaagatggtcaccataattagttcacaagtagaagaatttccagcaccatgtcatacatagttcattctaaattcacctggagattgaagaggacatctgtgtatgctaattacttatattcaatgacaaataaacttttcacctctttataacaggtggtagtttagcaggataatcgcttgaacctgggaagt

SEQ ID NO: 73240 - DNA, 361 bp, Homo sapiens
ataattcttacatatccatttctgtaattgagctaaaataatacagaatctattgctgtcagataatagaaattctcagtttctaaaatggactctagcatgataactattttaaatttctataaatattaaaagacttataagaaggaaactttgtagtttgctgaaactcttatgtaacttttcattaataaaagtaaagtagccatgcaggtcttgtagatggtttcctgcttctgctgccaaatttaatgattttagttaaatttcataaagggaaatataaatatattatacttaaaggatatagacacttaaaacaacagacccatgcctgaataactcttgcagaataattgtc

SEQ ID NO: 73241 - DNA, 442 bp, Homo sapiens
cgtgggaagggtttgctaacacccagatcacataccacagacatgttcagtagagtacatgaaaacttttgtaaattttaaaaaatgatgaaagtttacatatgttcacgtttgtgtgtacagatataaatgtataatttcagcatttcattgtctacattttctattttgggaacatgatttgaatcacattccaaatatgatggttgctcacatccacaagttcccagaacaagataatgtccattttgaaggttctaggctgtaggagtgtgaggccctggaagttcccacatacacagaggtgaaggctgccacactgggttctagttattagtggctcagggaaggttctttgctgggttttcaccctgcttaatgtgctctgccaaccaggacagaggaatatgttttacaatgatctgaatcaaatgcaactaga

SEQ ID NO: 73242 - DNA, 2561 bp, Homo sapiens
  misc_feature (799)..(799): n is a, c, g, or t
  misc_feature (813)..(813): n is a, c, g, or t
  misc_feature (1118)..(1118): n is a, c, g, or t
  misc_feature (1647)..(1647): n is a, c, g, or t
  misc_feature (1649)..(1649): n is a, c, g, or t
tgcgcagaacagctctggtcctcacagccagtgcaccggaggggcgcgctcccgagctggcgcagtttcccagcgcggtgcccgcccctcatcctcctccagtctccctcccctcgccgactgccgccccaggctccgccatggggaatgtgccatccgcggtgaagcactgcctcagctaccagcagcttctccgggagcatctctggatcggggattcagtggcaggggcgctcgaccccgcgcaggaaacatcccagttatctggactccctgagtttgttaaaatagtagaagttgggcctagggatggattgcagaatgaaaaggttatagttcctacagatataaaaattgaatttatcaatcgactttcccaaactggcttgtctgtaatagaagtgactagctttgtgtcttccagatgggtaccacaggttgctgctggagctactgagatatcagtttttggagctgcatctgaatcctttagcaagaagaatattaactgttccattgaagaaagtatgggaaaatttgaggaggttgttaagtctgcaagacacatgaatattccagcacgagggtacttatgaaatcccacaaattctgttttgttaatgtttattgttaaagcttactcaaaaattatctagagattcttatatcatttataaaaatatacatagaatatcatatttctattttgtttaatcagggtaatcactatatagttacatctcattaacatcactgctgattattagtgagtatctagcttgtggaatgtgtcatgcanttgaaatcagaggnactagcatgcaaatctggcattattaactattttattaacactctagcacccaaatgcagccctcttatctcagcctacatgtgctgataagttggtataaactcacaacagcttttggaaaagaatcacctaatgtggttttcaaattttttttaaaacatgactttttcttcaaagagtattttatgtagaacttcaatagaatacagcagatataaaattgagctgctctgggaaatcattttatccattctttctccccctcaatggctgacttttctacttcctctgggtgatcccaaancacctccatagtatcttgcagaacactgtttaaaaatacttgataaattgcttatagaagataaatataaactttcagttctctactattttctattatatgtgatttctataaatttaggagtatcagagatatcaatccctttctcctcgccttgcctttttcttgtggaaacttatcagctgttcattctaagagatgttgattacaggacatggaaaataaaaactgacccaagatccacaaacctaattttctctctcaggagtttagaaatggtataccaaacatggttacttgtattgaaagattatgtgattttgtcactgagttcactattttggggttcctaggatggagccacatgcaaaccagtgacaggacagagtagtagaaagcagaaatggaaaaaggaggctcctagcggtgatgagaggtatgggggagggaggagagggaaaaatctgccttggtgcttgtctgcttccaggaccaatagttgcctcaagtattataaccaggcctatgngntgtgaaacctataatgcatttttgtgtgtgtttgtttcttaaggaagaatttgtttctaagacattagctactttttctattaattttataaatatggagatatgatgaacacacatcttaacaagttaaagtgcatagcgattggtaatagaaggttgaaagctggggatggatttgggtgcaggctgtacttcccttagttgaggtgagcaaagttcatggtagcgggaaagattcaacagttaatgagaaagataagtgagtcaattgtgactgaaaatattagtgaaatgattggaatttcaatcaaggtgttttgggggaacaattagagttagactatacctagtaaaatattttgttagtttgttttctatttatatttttcctgtcctccatagtaagtctacatgagtttctaaaatttgaaattacttttgtaattaagatagatgcatatcatgtaaggactatatgagaaaaatttaaaatccaaggcaatgtacttccaaagacataaaataaaggatatttatttttcaggcaaaagttacaaaaccacaatcaaaaaggagagatatactattggtttctcaattcgaatataaataagttgtctcaattttctttaaaataaagagaaagatgaagaccctattctacttcaatatgtgtttaaagtgtggagtataagctttaaagtaattctcattgggaagttaaaaagtatgtgactataagaagtaaattgcttatgtagcttgctcttcaaataggaagggtttttttagtgttgaaagatggatgcaaatataagttgtaggaagtaaccttttattatcttagctttctgttgtaaaatggaatagttaatgtaactgggctaataaaaatcttaaaccctcttaata

SEQ ID NO: 73243 - DNA, 2368 bp, Homo sapiens
tgcgcagaacagctctggtcctcacagccagtgcaccggaggggcgcgctcccgagctggcgcagtttcccagcgcggtgcccgcccctcatcctcctccagtctccctcccctcgccgactgccgccccaggctccgccatggggaatgtgccatccgcggtgaagcactgcctcagctaccagcagcttctccgggagcatctctggatcggggattcagtggcaggggcgctcgaccccgcgcaggaaacatcccagttatctggactccctgagtttgttaaaatagtagaagttgggcctagggatggattgcagaatgaaaaggttatagttcctacagatataaaaattgaatttatcaatcgactttcccaaactggcttgtctgtaatagaagtgactagctttgtgtcttccagatgggtaccacaggttgctgctggagctactgagatatcagtttttggagctgcatctgaatcctttagcaagaagaatattaactgttccattgaagaaagtatgggaaaatttgaggaggttgttaagtctgcaagacacatgaatattccagcacgagggtatgtgtcttgtgctctgggctgtccatatgaaggaagtattacaccgcaaaaagtgacagaagtgtctaagagattgtacggcatgggttgttatgagatctctctaggagacacaattggagtgggaactccaggaagtatgaaaagaatgttggaaagtgtgatgaaagaaatcccaccaggtgctcttgctgttcactgtcatgacacatacggacaagccttagcaaatatccttacggcccttcagatgggaattaatgtggtggactccgcagtatccggattaggtggctgcccttatgcaaaaggtgcttctgggaatgtagccactgaggatttgatatatatgcttaatggcctggggctcaatacaggtgtgaatctatacaaagtgatggaagctggtgactttatttgcaaagctgtgaataaaaccacaaactctaaagtagcacaagcctccttcaatgcttgacttgaatggatttatgacgtaccgttgagaagatcaatttcagctacaatactcatctgaaaatcattaatgccaacttgctctgatatgtgaagtaatggacaagagtgggaaaaaagagatccttttcaaaaagattataactggatagattaagtcaacaaaatgcaatatcagtcatcaggtaaattgcaagctgaggataaataataaaacttgtcataattttgaacttggaaaaaagtttcttttgctctcatagaaataactttttaatttagtagatgggaaaattgacttcgtatttccccaagtatcaaatactgtgttaatacttaatcaagcaggcttaacactgtgtacatattgtcagtagtttatgagctcctgcatagtatgcagagtgtgtggcctcaatattatacattatgcctctggatctcaactactcatttgccaagtcagttatgttatggaccaaaagccaaatctccatctgaccctacataattttagcaatagaacttttatatttcaagtatggctaacatctgttaactatttcagtgactttatctggttccaagaggctgtggccaatggcaagatgccatatcctggaaacatattacgacctcccatgtttgttacatgcatccagtttaccacactttacctgtcatcagttatagtaaaaaccagcatggtgttactcaactattgagaaattgtaagctattttttttgtcctgatgtctaaattgcagtgataagaataggttgatacatgtatcataatctacctttataattttcagatcactttcaaattgcccaaggaaatattgtgatcctaagaatattaagataattttaggttaatgaaatacccattttccttttattcatggtgctttgcttacccacattattttttggtgtattttttagtggttattttagaagttgaagtggctgaaattttgtctattgtcttagaattgattgccagaaattgcaagatgtaatatatcaaagtcagggatgaggagcaggaggactattcaagataaacttctgtaacctatgcatattttatgggggcagtattattacaaatggatctgaaatgtcagttctagtatttagagagacttctctaataataccgggtgatattatctttgagtaaatttgaatataaattgaaacataaaaatgagtattgtgaactttctcggaaatattcattaaaaccattgaaataaaaataaattcaagaaagtaagaagtactgatta

SEQ ID NO: 73244 - DNA, 2219 bp, Homo sapiens
tgcgcagaacagctctggtcctcacagccagtgcaccggaggggcgcgctcccgagctggcgcagtttcccagcgcggtgcccgcccctcatcctcctccagtctccctcccctcgccgactgccgccccaggctccgccatggggaatgtgccatccgcggtgaagcactgcctcagctaccagcagcttctccgggagcatctctggatcggggattcagtggcaggggcgctcgaccccgcgcaggaaacatcccagttatctggactccctgagtttgttaaaatagtagaagttgggcctagggatggattgcagaatgaaaaggttatagttcctacagatataaaaattgaatttatcaatcgactttcccaaactggcttgtctgtaatagaagtgactagctttgtgtcttccagatgggtaccacaggtatgtgtcttgtgctctgggctgtccatatgaaggaagtattacaccgcaaaaagtgacagaagtgtctaagagattgtacggcatgggttgttatgagatctctctaggagacacaattggagtgggaactccaggaagtatgaaaagaatgttggaaagtgtgatgaaagaaatcccaccaggtgctcttgctgttcactgtcatgacacatacggacaagccttagcaaatatccttacggcccttcagatgggaattaatgtggtggactccgcagtatccggattaggtggctgcccttatgcaaaaggtgcttctgggaatgtagccactgaggatttgatatatatgcttaatggcctggggctcaatacaggtgtgaatctatacaaagtgatggaagctggtgactttatttgcaaagctgtgaataaaaccacaaactctaaagtagcacaagcctccttcaatgcttgacttgaatggatttatgacgtaccgttgagaagatcaatttcagctacaatactcatctgaaaatcattaatgccaacttgctctgatatgtgaagtaatggacaagagtgggaaaaaagagatccttttcaaaaagattataactggatagattaagtcaacaaaatgcaatatcagtcatcaggtaaattgcaagctgaggataaataataaaacttgtcataattttgaacttggaaaaaagtttcttttgctctcatagaaataactttttaatttagtagatgggaaaattgacttcgtatttccccaagtatcaaatactgtgttaatacttaatcaagcaggcttaacactgtgtacatattgtcagtagtttatgagctcctgcatagtatgcagagtgtgtggcctcaatattatacattatgcctctggatctcaactactcatttgccaagtcagttatgttatggaccaaaagccaaatctccatctgaccctacataattttagcaatagaacttttatatttcaagtatggctaacatctgttaactatttcagtgactttatctggttccaagaggctgtggccaatggcaagatgccatatcctggaaacatattacgacctcccatgtttgttacatgcatccagtttaccacactttacctgtcatcagttatagtaaaaaccagcatggtgttactcaactattgagaaattgtaagctattttttttgtcctgatgtctaaattgcagtgataagaataggttgatacatgtatcataatctacctttataattttcagatcactttcaaattgcccaaggaaatattgtgatcctaagaatattaagataattttaggttaatgaaatacccattttccttttattcatggtgctttgcttacccacattattttttggtgtattttttagtggttattttagaagttgaagtggctgaaattttgtctattgtcttagaattgattgccagaaattgcaagatgtaatatatcaaagtcagggatgaggagcaggaggactattcaagataaacttctgtaacctatgcatattttatgggggcagtattattacaaatggatctgaaatgtcagttctagtatttagagagacttctctaataataccgggtgatattatctttgagtaaatttgaatataaattgaaacataaaaatgagtattgtgaactttctcggaaatattcattaaaaccattgaaataaaaataaattcaagaaagtaagaagtactgatta

SEQ ID NO: 73245 - DNA, 2464 bp, Homo sapiens
tgcgcagaacagctctggtcctcacagccagtgcaccggaggggcgcgctcccgagctggcgcagtttcccagcgcggtgcccgcccctcatcctcctccagtctccctcccctcgccgactgccgccccaggctccgccatggggaatgtgccatccgcggtgaagcactgcctcagctaccagcagcttctccgggagcatctctggatcggggattcagtggcaggggcgctcgaccccgcgcaggaaacatcccagttatctggactccctgagtttgttaaaatagtagaagttgggcctagggatggattgcagaatgaaaaggttatagttcctacagatataaaaattgaatttatcaatcgactttcccaaactggcttgtctgtaatagaagtgactagctttgtgtcttccagatgggtaccacagatggctgatcacactgaagtaatgaaaggcattcatcaatatccaggagttcgctatcctgtccttactcctaatcttcagggttttcaccatgctgttgctgctggagctactgagatatcagtttttggagctgcatctgaatcctttagcaagaagaatattaactgttccattgaagaaagtatgggaaaatttgaggaggttgttaagtctgcaagacacatgaatattccagcacgagggtatgtgtcttgtgctctgggctgtccatatgaaggaagtattacaccgcaaaaagtgacagaagtgtctaagagattgtacggcatgggttgttatgagatctctctaggagacacaattggagtgggaactccaggaagtatgaaaagaatgttggaaagtgtgatgaaagaaatcccaccaggtgctcttgctgttcactgtcatgacacatacggacaagccttagcaaatatccttacggcccttcagatgggaattaatgtggtggactccgcagtatccggattaggtggctgcccttatgcaaaaggtgcttctgggaatgtagccactgaggatttgatatatatgcttaatggcctggggctcaatacaggtgtgaatctatacaaagtgatggaagctggtgactttatttgcaaagctgtgaataaaaccacaaactctaaagtagcacaagcctccttcaatgcttgacttgaatggatttatgacgtaccgttgagaagatcaatttcagctacaatactcatctgaaaatcattaatgccaacttgctctgatatgtgaagtaatggacaagagtgggaaaaaagagatccttttcaaaaagattataactggatagattaagtcaacaaaatgcaatatcagtcatcaggtaaattgcaagctgaggataaataataaaacttgtcataattttgaacttggaaaaaagtttcttttgctctcatagaaataactttttaatttagtagatgggaaaattgacttcgtatttccccaagtatcaaatactgtgttaatacttaatcaagcaggcttaacactgtgtacatattgtcagtagtttatgagctcctgcatagtatgcagagtgtgtggcctcaatattatacattatgcctctggatctcaactactcatttgccaagtcagttatgttatggaccaaaagccaaatctccatctgaccctacataattttagcaatagaacttttatatttcaagtatggctaacatctgttaactatttcagtgactttatctggttccaagaggctgtggccaatggcaagatgccatatcctggaaacatattacgacctcccatgtttgttacatgcatccagtttaccacactttacctgtcatcagttatagtaaaaaccagcatggtgttactcaactattgagaaattgtaagctattttttttgtcctgatgtctaaattgcagtgataagaataggttgatacatgtatcataatctacctttataattttcagatcactttcaaattgcccaaggaaatattgtgatcctaagaatattaagataattttaggttaatgaaatacccattttccttttattcatggtgctttgcttacccacattattttttggtgtattttttagtggttattttagaagttgaagtggctgaaattttgtctattgtcttagaattgattgccagaaattgcaagatgtaatatatcaaagtcagggatgaggagcaggaggactattcaagataaacttctgtaacctatgcatattttatgggggcagtattattacaaatggatctgaaatgtcagttctagtatttagagagacttctctaataataccgggtgatattatctttgagtaaatttgaatataaattgaaacataaaaatgagtattgtgaactttctcggaaatattcattaaaaccattgaaataaaaataaattcaagaaagtaagaagtactgatta

SEQ ID NO: 73246 - DNA, 2093 bp, Homo sapiens
tgcgcagaacagctctggtcctcacagccagtgcaccggaggggcgcgctcccgagctggcgcagtttcccagcgcggtgcccgcccctcatcctcctccagtctccctcccctcgccgactgccgccccaggctccgccatggggaatgtgccatccgcggtgaagcactgcctcagctaccagcagcttctccgggagcatctctgaatcctttagcaagaagaatattaactgttccattgaagaaagtatgggaaaatttgaggaggttgttaagtctgcaagacacatgaatattccagcacgagggtatgtgtcttgtgctctgggctgtccatatgaaggaagtattacaccgcaaaaagtgacagaagtgtctaagagattgtacggcatgggttgttatgagatctctctaggagacacaattggagtgggaactccaggaagtatgaaaagaatgttggaaagtgtgatgaaagaaatcccaccaggtgctcttgctgttcactgtcatgacacatacggacaagccttagcaaatatccttacggcccttcagatgggaattaatgtggtggactccgcagtatccggattaggtggctgcccttatgcaaaaggtgcttctgggaatgtagccactgaggatttgatatatatgcttaatggcctggggctcaatacaggtgtgaatctatacaaagtgatggaagctggtgactttatttgcaaagctgtgaataaaaccacaaactctaaagtagcacaagcctccttcaatgcttgacttgaatggatttatgacgtaccgttgagaagatcaatttcagctacaatactcatctgaaaatcattaatgccaacttgctctgatatgtgaagtaatggacaagagtgggaaaaaagagatccttttcaaaaagattataactggatagattaagtcaacaaaatgcaatatcagtcatcaggtaaattgcaagctgaggataaataataaaacttgtcataattttgaacttggaaaaaagtttcttttgctctcatagaaataactttttaatttagtagatgggaaaattgacttcgtatttccccaagtatcaaatactgtgttaatacttaatcaagcaggcttaacactgtgtacatattgtcagtagtttatgagctcctgcatagtatgcagagtgtgtggcctcaatattatacattatgcctctggatctcaactactcatttgccaagtcagttatgttatggaccaaaagccaaatctccatctgaccctacataattttagcaatagaacttttatatttcaagtatggctaacatctgttaactatttcagtgactttatctggttccaagaggctgtggccaatggcaagatgccatatcctggaaacatattacgacctcccatgtttgttacatgcatccagtttaccacactttacctgtcatcagttatagtaaaaaccagcatggtgttactcaactattgagaaattgtaagctattttttttgtcctgatgtctaaattgcagtgataagaataggttgatacatgtatcataatctacctttataattttcagatcactttcaaattgcccaaggaaatattgtgatcctaagaatattaagataattttaggttaatgaaatacccattttccttttattcatggtgctttgcttacccacattattttttggtgtattttttagtggttattttagaagttgaagtggctgaaattttgtctattgtcttagaattgattgccagaaattgcaagatgtaatatatcaaagtcagggatgaggagcaggaggactattcaagataaacttctgtaacctatgcatattttatgggggcagtattattacaaatggatctgaaatgtcagttctagtatttagagagacttctctaataataccgggtgatattatctttgagtaaatttgaatataaattgaaacataaaaatgagtattgtgaactttctcggaaatattcattaaaaccattgaaataaaaataaattcaagaaagtaagaagtactgatta

SEQ ID NO: 73247 - DNA, 337 bp, Homo sapiens
aaaaagccaaagcctttcaatggctaacagggccctatacaatgccccctacccactacctctctgagtttgtcttttaggactctccctctggcttactcttctgcagccacactgctctcatcatttcttaaaagtcccagggacaagctgtctgaggtttctgctgttgctgtgccctctgtgtagaaggctcttctgctagatattcacatggcctgctctcctattaccttcaggtctttgcacaatgtacaccttctcaatgaggtcttccttgaccattttatttaaaaacagaccaagcccaacactacctaaactcctagaatgcaaa

SEQ ID NO: 73248 - DNA, 264 bp, Homo sapiens
tagtagaaatggggtttcaccatgttggccaggatggtctcgatctcctgacctcgtgatccacccaccttcggcctcccaaagtgctgggattacaggagtgagccactgcgccctgtcggaacacttttcttaatactgaaatatacattttagtagtttcagtcatggttacatgtattagaataaaataattttaatattttgatatactgaagcactttcatgataatatttaggaaactaatcagggtacctctttag

SEQ ID NO: 73249 - DNA, 642 bp, Homo sapiens
cggggagtctgaggcaggagaatcacttgaacctgtgaggtggaggttgcagtgagccgagatcatgccattgcactccagcctggtgacagagtgagaccccatctctaaataaataaataaggcttcattcttttccaccagttccattcatgttttccctatgcccagcacaatgtgctacgaagcataaaagtagaacaaatgacctgtagtagcagagagataggtatacaggtactgaaaccttgatgtacttgtttgaattagatatgtagaaaggataatggaggtagaggagatagaacatctgatggcattgatagcagttaggttaagcatcacaaggattactacaggaactgatacgtgtgtgtgtgtgtgtgtgtgtgtgtgtgtgttttaagtcggatacatgtgcaggtttgttacataggtaaacttgtgtcatgggggtttgttgaacagattatttcatcacccaggtgttaagcctagtactcattagttatttttcctgattctctccctcctctccaccctctgccctacgataggccccattgtgtgttgttcccctctcttcgttcatgttttttcatcatttagctcccgcttataagtgaaaacatactgtatttg

SEQ ID NO: 73250 - DNA, 298 bp, Homo sapiens
attattcgaaaattcaaaatgctcccaattaaaaaattccaaaagaagtcaaaatagcatgaattttaaaatcacagttatgaagactgcataaaaacatgggaaaaagcttgaaatgctggatacaaactgtattcataggatacagaggcatttgcaaaaggatttttaggaaacaggccaaaataagactgactatgatatagagtgggattatgtgtttttttcttttcttctagtatccaaatttcctgcaatatgatttgaagaatattaaaataattatacttaattttaa

SEQ ID NO: 73251 - DNA, 99 bp, Homo sapiens
tgaaaacgaatccccaggatgagagtatttgtagctggggcctttgggaggtgagatcaaatctccagtgaatgggattactgcccttacaatagaagc

SEQ ID NO: 73252 - DNA, 586 bp, Homo sapiens
gcggccgccaggggtccccgctcggcgtccccgcgagacagtcgagccccggccggctgcgcggcgcgctgggtgcatgagggggctgctccggagcgacggcggctgcagctggagccaggcgctcgcccgtccgccggttggctcgccgggacctcgcgcaccggcggcagagtcccttgcgtggattggcaagcgacgccccacctgccccgagctcaccattttctttcgcgctggctgcagctgacccggcgaagggagccgaccgggccctgggctggaggtaaaaccccacggtgagtaagaacccgctccaagctaggggaggcggcgcagcccggtggctgctcgctcccgatctcgcccgggcgggcggcgaggtttggggcgcacctgggcgcgggtgcaagaaggtgcgggaggcggcggaccggtcttctgcccgccggccacgggcttccggggctggagtcctcttcagacccctgccggcgcctgggtttctggccggctcctcgtgtgcacttcccggcaggaacaagggtcgcccactttccaccccgggatcttgatttgtccttga

SEQ ID NO: 73253 - DNA, 462 bp, Homo sapiens
gcggccgccaggggtccccgctcggcgtccccgcgagacagtcgagccccggccggctgcgcggcgcgctgggtgcatgagggggctgctccggagcgacggcggctgcagctggagccaggcgctcgcccgtccgccggttggctcgccgggacctcgcgcaccggcggcagagtcccttgcgtggattggcaagcgacgccccacctgccccgagctcaccattttctttcgcgctggctgcagctgacccggcgaagtttggggcgcacctgggcgcgggtgcaagaaggtgcgggaggcggcggaccggtcttctgcccgccggccacgggcttccggggctggagtcctcttcagacccctgccggcgcctgggtttctggccggctcctcgtgtgcacttcccggcaggaacaagggtcgcccactttccaccccgggatcttgatttgtccttga

SEQ ID NO: 73254 - DNA, 2720 bp, Homo sapiens
gcggccgccaggggtccccgctcggcgtccccgcgagacagtcgagccccggccggctgcgcggcgcgctgggtgcatgagggggctgctccggagcgacggcggctgcagctggagccaggcgctcgcccgtccgccggttggctcgccgggacctcgcgcaccggcggcagagtcccttgcgtggattggcaagcgacgccccacctgccccgagctcaccattttctttcgcgctggctgcagctgacccggcgaagggagccgaccgggccctgggctggaggtaaaaccccacggaaagaacatgaggttcccttggaaatcattcaagaggaagatggaaggggctgtttagaagagcttaaaagctacaggctgtaagactggggcctgagtgctggcagtggaaaacactgttgggctgtgatctctccctgaaaagttccaggtgcctttttgcttcctgcaaaagaaaggaagcgaaagagaagaccatgtccatagccctgaagcaggtattcaacaaggacaagaccttccgacccaagaggaaatttgaacctggcacacagaggtttgagctgcacaaacgggctcaggcatccctcaactcgggtgtggacctgaaggcggctgtgcagttgcccagtggggaggaccagaatgactgggtggcagtacatgtggtggacttcttcaatcggatcaacctcatctatggcaccatctgtgagttctgcaccgagcggacctgtcctgtgatgtcagggggccccaaatatgagtatcggtggcaggatgatctcaagtataagaagccaacagcgctgccagctccccagtacatgaaccttcttatggattggattgaggttcagatcaacaacgaggaaatatttccaacatgcgtgggtgttcccttcccaaagaacttccttcagatctgcaagaagatcctgtgccgccttttccgggtctttgtccacgtctatatccaccacttcgaccgggtcattgtgatgggtgcagaggcccatgtcaacacctgctacaaacacttctattactttgtcacagagatgaacctcatagaccgcaaggagctagagcctttgaaagaaatgacgagcaggatgtgtcactaatgctccacctcaccctttggaagaaaggaaagctgtttcctcctggtgccctgagcgggcaggaggtggaccaccctggctgaaatgacacacctactcccaggaacagcagaggtggaggcaagcagtgactcctgagagacattccccactcactttgtgtgctcttaaccttctgagtgctgctagcccagacctgtggacgaggcagaccacaacgtgaaagaaggaccagccccttgaccgttctggctggggaattgtccacgaggaagcctctgcacttccacacatggcacagttctgcctgtgacctgccgcctaagctttactggaattcaggttttgagactgagatgcgtgttcgtatttttccacttatctgtcttgtcagctggccgacttctctgtgattggttttttaagtgccgggtgaattttggacctctggatgtgcagcaagtttttatgcaataagccttcctttcaggtctctaaaagctcctgctctgatctgtggtttaacactgtgcagggctgtggagctctgagagacctgaacccctacccatcccctgcacctccctactctccctgccgaggcgtccatagcatttccctaataaatagttttatcagggacactccatggggtggcttgtctctgccccaaacagggtcttcacgttctaactgcagggaagagactggttactagcgtaaagctgacaagttaccagttcacctgatcagaatgtattttttataaccaccatcattccttgtctcttcagtggaagatattctttcctgtttcccagaagagagaaataaaagtcctaaataactaagaatgatcagcgggagcgttgggcatgattactgcagtgtttgttctttattaaagacagggagtcgtggctgtctctacataatactaacatttcagtgaaaaaagtacagttggttatttggtacgtgtagatttaacacccagacggctgacttgtaaccctccccactagccttctgagcatttaaacccagccgtcattctctccccactccacgctccccactcctctgccacgttatgttacggcacaaaattaatttctgcccctgtgattgggccacggttgccaaggtaacagtggagctggagctaacttccttctttcatcctttccaatttttctattccagaagacagtcagaataatgcattctgtactacatcctgccttttgaaacctaaatgagttttcgttgatgaaatgttgccttctctgattcattcacaaaactgtggtggttctgaccacctgtgacgaggggggtcataatacttccagtgatccttttaatttagcaaaatatttgtcggtggagggaagtagataagaatgtattagtgtattttaaagtaataatgattaaagaataactaaatgactctgattttgttttatcaatcataatgtgttaaagccctctgtggctgccacaaaagactagaatcatgaaatctttgtccaagctaagaaagggctgtctctgtgggtacagtgg

SEQ ID NO: 73255 - DNA, 2609 bp, Homo sapiens
gcggccgccaggggtccccgctcggcgtccccgcgagacagtcgagccccggccggctgcgcggcgcgctgggtgcatgagggggctgctccggagcgacggcggctgcagctggagccaggcgctcgcccgtccgccggttggctcgccgggacctcgcgcaccggcggcagagtcccttgcgtggattggcaagcgacgccccacctgccccgagctcaccattttctttcgcgctggctgcagctgacccggcgaagggagccgaccgggccctgggctggaggtaaaaccccacggaaagaacatgaggttcccttggaaatcattcaagaggaagatggaaggggctgtttagaagagcttaaaagctacaggctgtaagactggggcctgagtgctggcagtggaaaacactgttgggctgtgatctctccctgaaaagttccaggtgcctttttgcttcctgcaaaagaaaggaagcgaaagagaagaccatgtccatagccctgaagcaggtattcaacaaggacaagaccttccgacccaagaggaaatttgaacctggcacacagaggtttgagctgcacaaacgggctcaggcatccctcaactcgggtgtggacctgaaggcggctgtgcagttgcccagtggggaggaccagaatgactgggtggcagtacatgtggtggacttcttcaatcggatcaacctcatctatggcaccatctgtgagttctgcaccgagcggacctgtcctgtgatgtcagggggccccaaatatgagtatcggtggcaggatgatctcaagtataagaagccaacagcgctgccagctccccagtacatgaaccttcttatggattggattgaggttcagatcaacaacgaggaaatatttccaacatgcgtgggtgttcccttcccaaagaacttccttcagatctgcaagaagatcctgtgccgccttttccgggtctttgtccacgtctatatccaccacttcgaccgggtcattgtgatgggtgcagaggcccatgtcaacacctgctacaaacacttctattactttgtcacagagatgaacctcatagaccgcaaggagctagagcctttgaaagaaatgacgagcaggatgtgtcactaatgctccacctcaccctttggaagaaaggaaagctgtttcctcctggtgccctgagcgggcaggaggtggaccaccctggctgaaatgacacacctactcccaggaacagcagaggtggaggcaagcagtgactcctgagagacattccccactcactttgtgtgctcttaaccttctgagtgctgctagcccagacctgtggacgaggcagaccacaacgtgaaagaaggaccagccccttgaccgttctggctggggaattgtccacgaggaagcctctgcacttccacacatggcacagttctgcctgtgacctgccgcctaagctttactggaattcaggttttgagactgagatgcgtgttcgtatttttccacttatctgtcttgtcagctggccgacttctctgtgattggttttttaagtgccgggtgaattttggacctctggatgtgcagcaagtttttatgcaataagccttcctttcaggtctctaaaagctcctgctctgatctgtggtttaacactgtgcagggctgtggagctctgagagacctgaacccctacccatcccctgcacctccctactctccctgccgaggcgtccatagcatttccctaataaatagttttatcagggacactccatggggtggcttgtctctgccccaaacagggtcttcacgttctaactgcagggaagagactggttactagcgtaaagctgacaagttaccagttcacctgatcagaatgtattttttataaccaccatcattccttgtctcttcagtggaagatattctttcctgtttcccagaagagagaaataaaagtcctaaataactaagaatgatcagcgggagcgttgggcatgattactgcagtgtttgttctttattaaagacagggagtcgtggctgtctctacataatactaacatttcagtgaaaaaagtacagttggttatttggtacgtgtagatttaacacccagacggctgacttgtaaccctccccactagccttctgagcatttaaacccagccgtcattctctccccactccacgctccccactcctctgccacgttatgttacggcacaaaattaatttctgcccctgtgattgggccacggttgccaaggtaacagtggagctggagctaacttccttctttcatcctttccaatttttctattccagaagacagtcagaataatgcattctgtactacatcctgccttttgaaacctaaatgagttttcgttgatgaaatgttgccttctctgattcattcacaaaactgtggtggttctgaccacctgtgacgaggggggtcataatacttccagtgatccttttaatttagcaaaatatttgtcggtggagggaagtagataagaatgtattagtgtattttaaagtaataatgattaaagaataactaaatgactctga

SEQ ID NO: 73256 - DNA, 2686 bp, Homo sapiens
cccccctgggcgtcccaaccctggtgggaacggtgtggtggaggtgtacagtgctgctgcgcccctggctgggagtggaacggtggagatccaggcactggggatgcagccctacccacccccctcctaggtgccaaaccagtgtgtggagcctccagtatatcccacccccacagtgtacagccctggcaaacagggattcaaacccaaaggaccaaaccccgccgcccccatgaccagcgccaccgggggcacggtggccacctttgactctccagcaacgctgaagacccgacgagctaaagctgcagggaagccaaaggctcagaaactcaagtgctcatactgtgacaagtcattcaccaaaaactttgacctgcagcagcacatccgaagccacaccggtgagaagcccttccagtgcattgcatgtggccgtgcctttgcccagaagtctaatgttaagaaacacatgcagacccacaaggtgtggcctccaggacacagtggtggcaccgtgtctcgaaactctgtgaccgtacaggtcatggccctgaaccccagcaggcaggaggacgaggaaagcacagggttgggccagcccctgccgggtgcgccacagccccaggccttgtccacagctggtgaggaagagggggacaagccggagtccaagcaggtggtcctcatcgacagctcctacctgtgccaattctgccccagcaaattcagcacctacttccagctcaagtctcacatgacccagcataagaatgagcaggtgtacaagtgtgtggtcaaaagctgtgcccagacgttcccaaagctcgacacatttctggagcacatcaagagccaccaggaggagctgagctaccgctgccacctctgcggcaaggacttcccctcgctgtacgacctgggcgtgcaccagtactcccacagcctcctgccacagcacagccccaagaaggacaatgccgtctacaagtgtgtcaaatgtgtcaacaaatactccacccctgaggccctggagcaccacctgcagaccgccactcacaacttcccctgcccacactgccagaaggtgtttccttgtgaacgctacctgcggcgtcatctgcccacccacggcagcgggggcaggttcaagtgccaagtgtgcaagaagttcttccggcgggagcattatctcaaactgcatgctcacatccactcgggtgagaagccctacaaatgctcagtgtgcgagtctgcgttcaaccgcaaggacaaactgaagagacacatgttgatccacgagcccttcaagaaatacaaatgccctttctcgacgcacacagactgcagtaaggagttcaaccggccggacaagctgaaggcccacatcctctcccactctggcatgaagctccacaaatgcgccctgtgcagcaagtccttcagccgccgtgcccacctcgccgagcatcagcgcgcccacatgggcaactacaagttccgctgtgctggctgcgccaagggcttttcccgccacaaatacctcaaagatcaccgctgtcgtctcggcccccaaaaggacaaggacctgcaaacccggcggcccccccagaggagggcagccccccgcagttgcggcagtggtgggcgcaaggtgctgacccccttgcctgacccgctggggctggaggagctgaaggacacaggggctgggctggtgcccgaggctgtccccggcaagccgcccttcgcagagccggacgcggtgctgtccatcgttgtgggtggtgcggtgggcgcggaaactgagctggtggtacctggacacgctgaggggctgggctccaacctggctctggcggagctgcaggccggggccgagggcccatgtgccatgctcgctgtgcccgtctacatccaggcctccgagtgacggacctgaggtgtctgtttcctgggcaggcctgatgctcctgtttgggtccagggcccctgggggcagaccggtgatccttaccagtggaagcgagccatcgagccattggcagaaatcctgctgaatgtcattcagaaacctcagcccatggtcgccctcctgtgcccctctcctgccggaaagccctgcaacattctagggttgggggcagggccatccacggtttctgggcagagccatggtggcaggagagagatggctgaagcctgagcagcccagagtcccgctggtctaggctggtggtcggggcccctgggagaggagacagggcattcctccccactctgtctccaggctgcctctgggtagcctctagtctgctgttcttcaggaggcctgccataaactcttcggagtttacgtgttgcaccttttcacagacggttccccacagcatcctcagacagctctgtgatgtagcttttaggaggcactcaggtgtcacggctagactgcagctatgagacagatctggcttcaaatccaagagttgccatgcacttgctgtgtgaccttgggcaagtcacttcacttctctgagccccgtgttcctcatctgtacaatggggcttacgatactactacctcatagggttgtcctggggatccagtatgatgaagtgcgccaggggcttggcatggtgcccggcacgcagaaagtgctcaataaatgtttttgtcataacgtga

SEQ ID NO: 73257 - DNA, 1125 bp, Homo sapiens
cccccctgggcgtcccaaccctggtgggaacggtgtggtggaggtgtacagtgctgctgcgcccctggctgggagtggaacggtggagatccaggcactggggatgcagccctacccacccccctcctaggtgccaaaccagtgtgtggagcctccagtatatcccacccccacagtgtacagccctggcaaacagggattcaaacccaaaggaccaaaccccgccgcccccatgaccagcgccaccgggggcacggtggccacctttgactctccagcaacgctgaagacccgacgagctaaagctgcagggaagccaaaggctcagaaactcaagtgctcatactgtgacaagtcattcaccaaaaactttgacctgcagcagcacatccgaagccacaccggtgagaagcccttccagtgcattgcatgtggccgtgcctttgcccagaagtctaatgttaagaaacacatgcagacccacaaggtgtggcctccaggacacagtggtggcaccgtgtctcgaaactctgtgaccgtacaggtcatggccctgaaccccagcaggcaggaggacgaggaaagcacagggttgggccagcccctgccgggtgcgccacagccccaggccttgtccacagctggtgaggaagagggggacaagccggagtccaagcaggtggtcctcatcgacagctcctacctgtgccaattctgccccagcaaattcagcacctacttccagctcaagtctcacatgacccagcataagaatgagcaggtaggtggatggtggcagcaggggcccacaccacaccagtcgaaacctttcactggtgctagggtcttgaatgctgcctagaaaggggtaggaaccagtgagtcagaccttccacggctctattccccccgggttagattccgagcaggggattgatgaagtaaggttacccttggggcaaatcacagaaaactttgactctcctccagacctgagacagctgactccacccagcgtaaggactctgtgtctttccagctctggtctctgtcatctcagggtgtggccttgacctctcctgatggctcaccttgtactcctgtcctgggatggtgatcacttct

SEQ ID NO: 73258 - DNA, 1283 bp, Homo sapiens
cccccctgggcgtcccaaccctggtgggaacggtgtggtggaggtgtacagtgctgctgcgcccctggctgggagtggaacggtggagatccaggcactggggatgcagccctacccacccccctcctaggtgccaaaccagtgtgtggagcctccagtatatcccacccccacagtgtacagccctggcaaacagggattcaaacccaaaggaccaaaccccgccgcccccatgaccagcgccaccgggggcacggtggccacctttgactctccagcaacgctgaagacccgacgagctaaagctgcagggaagccaaaggctcagaaactcaagtgctcatactgtgacaagtcattcaccaaaaactttgacctgcagcagcacatccgaagccacaccggtgagaagcccttccagtgcattgcatgtggccgtgcctttgcccagaagtctaatgttaagaaacacatgcagacccacaaggtgtggcctccaggacacagtggtggcaccgtgtctcgaaactctgtgaccgtacaggtcatggccctgaaccccagcaggcaggaggacgaggaaagcacagggttgggccagcccctgccgggtgcgccacagccccaggccttgtccacagctggtgaggaagagggggacaagccggagtccaagcaggtggtcctcatcgacagctcctacctgtgccaattctgccccagcaaattcagcacctacttccagctcaagtctcacatgacccagcataagaatgagcaggtgtacaagtgtgtggtcaaaagctgtgcccagacgttcccaaagctcgacacatttctggagcacatcaagagccaccaggaggagctgagctaccgctgccacctctgcggcaaggacttcccctcgctgtacgacctgggcgtgcaccagtactcccacagcctcctgccacagcacagccccaagaaggacaatgccgtctacaagtgtttccttgtgaacgctacctgcggcgtcatctgcccacccacggcagcgggggcaggttcaagtgccaagtgtgcaagaagttcttccggcgggagcattatctcaaactgcatgctcacatccactcgggtgagaagccctacaaatgctcagtgtgcgagtctgcgttcaaccgcaaggacaaactgaagagacacatgttgatccacgtatgatgaagtgcgccaggggcttggcatggtgcccggcacgcagaaagtgctcaataaatgtttttgtcataacgtga

SEQ ID NO: 73259 - DNA, 435 bp, Homo sapiens
cccccctgggcgtcccaaccctggtgggaacggtgtggtggaggtgtacagtgctgctgcgcccctggctgggagtggaacggtggagatccaggcactggggatgcagccctacccacccctagaggtgagcagagggggcagggtggaagaggacactggtcatggacatcatggccaacccggacccatcctgagcaccagctgtgtgccagacactgtgctggggataccatgaaaaccagacccggtcctggccttcatggggtgtaccacatcacaggggagaaggactttaatcaaagcatcacacccacagatgtaagatgcaagccatgagaaggtggaatggagtacaggttgtagcagaaatataagctgcctgcaggtaatgctcagaacagtcagagaatgcctaccttttcaggcaaaaaa

SEQ ID NO: 73260 - DNA, 1380 bp, Homo sapiens
cccccctgggcgtcccaaccctggtgggaacggtgtggtggaggtgtacagtgctgctgcgcccctggctgggagtggaacggtggagatccaggcactggggatgcagccctacccacccccctcctaggtgccaaaccagtgtgtggagcctccagtatatcccacccccacagtgtacagccctggcaaacagggattcaaacccaaaggaccaaaccccgccgcccccatgaccagcgccaccgggggcacggtggccacctttgactctccagcaacgctgaagacccgacgagctaaagctgcagggaagccaaaggctcagaaactcaagtgctcatactgtgacaagtcattcaccaaaaactttgacctgcagcagcacatccgaagccacaccggtgagaagcccttccagtgcattgcatgtggccgtgcctttgcccagaagtctaatgttaagaaacacatgcagacccacaaggtgtggcctccaggacacagtggtggcaccgtgtctcgaaactctgtgaccgtacaggtcatggccctgaaccccagcaggcaggaggacgaggaaagcacagggttgggccagcccctgccgggtgcgccacagccccaggccttgtccacagctggtgaggaagagggggacaagccggagtccaagcaggtggtcctcatcgacagctcctacctgtgccaattctgccccagcaaattcagcacctacttccagctcaagtctcacatgacccagcataagaatgagcaggtgtacaagtgtgtggtcaaaagctgtgcccagacgttcccaaagctcgacacatttctggagcacatcaagagccaccaggaggagctgagctaccgctgccacctctgcggcaaggacttcccctcgctgtacgacctgggcgtgcaccagtactcccacagcctcctgccacagcacagccccaagaaggacaatgccgtctacaagtgtgtcaaatgtgtcaacaaatactccacccctgaggccctggagcaccacctgcagaccgccactcacaacttcccctgcccacactgccagaaggtgtttccttgtgaacgctacctgcggcgtcatctgcccacccacggcagcgggggcaggttcaagtgccaagtgtgcaagaagttcttccggcgggagcattatctcaaactgcatgctcacatccactcgggtgagaagccctacaaatgctcagtgtgcgagtctgcgttcaaccgcaaggacaaactgaagagacacatgttgatccacgtatgatgaagtgcgccaggggcttggcatggtgcccggcacgcagaaagtgctcaataaatgtttttgtcataacgtga

SEQ ID NO: 73261 - DNA, 289 bp, Homo sapiens
ggcaaacagggattcaaacccaaaggaccaaaccccgccgcccccatgaccagcgccaccgggggcacggtggccacctttgactctccagcaacgctgaagacccgacgagctaaaggtgccaggggactcccggaaggtgggcccccagcctgccatgggcatctttcctcaacattggccaatccacaagctacttggttctggtcttcccttttatggttgttcaagtttggttgcatgtaatagaaaattcaaaatatcaatgacttcaaaatgatagaatttt

SEQ ID NO: 73262 - DNA, 623 bp, Homo sapiens
actttaaacaggtgaattgtttaaatctcagctgtttgggggaaagaaaaaaacaggttgggcttgataacctaaaatcctggacctgaataaaatataaatataagtcaggctggaaaactggacagcagggaaatcagagttgtaatcaattcctcatgtattccctcaggtcaccggaactgtcctcctcttctcaaaatagttggggagcaaggaatcatggatgtccttccacaattaatgactgaagactgtgcttgggaaatgtgtccatgaactccctgctctgaaggggtagttatgcacatcactagttttttgttagttttacatgttattgtgggaaaagttaaaaatataaaaaagacaaatgtttaactacccagcttcaacccatggccaggcttgtttcatctatatccccccccattccccccacccccatcctgtattaatttgaagcaaattccagacgtggcatcatttctttttttctttttcttttttttttttttgagacggagttttgctcttgtcatccaggctggagggcaatggcaggatctcagctcactgcaacctccgcctcctgagttcaagtgattctcctgcctcggcct

SEQ ID NO: 73263 - DNA, 363 bp, Homo sapiens
ctgagttaatctctagtttctctttcttgagatctgttcatgcctgcctggtcttcctttggttaggatcttttcttaccctttatatttctcaagtggtgaggttgaaatgttccgtgaactgtagcacaggtgtttatttaatcatccacatggtttcctcagagtctttcaatcttgacttgggatgaataggttacacctcaaatttctttaaagtcagtggaggcggcacagctctctccaaggaaatcgtcttcaaatatcatccaatttcttattttctaaaagtgggtgagggatttaaaggttatctaattttttaaaaagtttctcagatttctctaaaatttgcatcgtatt

SEQ ID NO: 73264 - DNA, 1643 bp, Homo sapiens
ctcccgtagtcgtagttcccgtagtatggcggcccctgccgccgccaccgccatgggcaacgcccccgccaagaaggacaccgagcaggaggagagcgtgaacgagttcctagccaaagccagaggagatttcctctacagatggggaaaccccgctcaaaacaccgccagctcggatcagttcgaacggctcaggacgctgggcatgggctccttcgggcgggtgatgctggtgaggcaccaggagaccggcggccactacgccatgaagatcctcaacaagcagaaggtggtgaagatgaagcaggtcgagcacatactgaacgagaagcgcatcctgcaggcgatcgactttccgttcctcgtcaagctccagttctcctttaaggacaactcctacctgtacctggtgatggagtacgtgccgggtggggagatgttctcccgcctacagcgcgtcggaaggtttagcgagccccatgcctgtttctatgccgcccaggtcgtcctggccgtccagtacctacactcgctcgacctcatccaccgcgacctgaagcccgagaatctcctcatcgaccagcagggctacctgcaggtgacggacttcggtttcgccaagcgcgtgaagggccgcacttggaccttgtgcgggaccccagagtacctggcccccgagatcatcctgagcaaaggctacaacaaggccgtggactggtgggccctaggggtgctcatctatgagatggccgtgggcttcccacccttctacgccgaccagcccatccagatctacgagaagatcgtctctgggagggtgcggtttccctccaaactcagctctgacctcaaggatctgctgcggagcctgctgcaggtggacctcaccaagcgcttcggaaacctcaggaacggggttggcgacatcaagaaccacaagtggttcgccacaaccagctggatcgccatctatgagaagaaggtggaagctcccttcatcccgaagtacacaggccctggggatgccagtaactttgacgactacgaggaggaagagctccggatctccatcaatgagaagtgtgccaaggagttttctgagttttaggggtgtgcttgtgcccctgtgggttttctttcctttttgtttttggtggtttgggggatgggagggttggattgaacagccagagggccccagagttccttgtatctaatttcatcctcaccccaccctccagggttgggggagcaggaagcccagatatttggaggaacagaaacaccagctgctccctcacccccccccatgccttcctggtccctctgtgcttctctctttctcctcccacaggtcccccttgccccagcccccttctgcctgttttaaacgagtttctcagctctattcaggccaggtcttgctgttgtatcaagggacacggtgtggaaagaggggctcaaacttaactccagccctgaacaggcaccacttactaagagaggatgaatgaaaagcacacctaccctttggcgtaatcctgcctgggaaggagagaggtttagtgccatgttcagtgggctgtttgctagaataaaaaattaaaacaaaaaacaattaaaatcttatttaagttccacca

SEQ ID NO: 73265 - DNA, 978 bp, Homo sapiens
  misc_feature (753)..(753): n is a, c, g, or t
  misc_feature (757)..(757): n is a, c, g, or t
  misc_feature (761)..(761): n is a, c, g, or t
gcctatctacatgagaactggcaactctaatttaccccgaagcctttctgcaggagattcaaatatttgctaatgcttactgataccttcactggttagatcgaggcattccccaccccatctgaaaaatgtttaccagaagaaataactcctcagtttgggtaatccaaaagcctgtaaagtgacaatggcccatctttcacagcaggtgtaacccaacacctatcctcagctttaagaatccaatattaccttcactctgctggagaccgcagtcctctggaaaggtgaaagggctaatcctaaagaagactctagctaaatcagaggcctgactatctctaatacccatagcttactgcgggtttgaactgctccaaagtaaaacgtataattaagtcctgttgagttaacatgtggaaggcctttcctaacgacagatctcctaatagatgaaaagactcatcaattacaaaaatatgtcatcaatctgggacaggtgcaaaggcactctgaatatggaaacaagcgtcttcccctcccacatgggaggaaaattcagtttcagctcagctagggatttagtcttactaaagacgtgggaggaagttctccagctgagcagctttccccaacgtggaaaggaccacgcaaggacacctgagttctccaacagatgttcaacaccaggggattcacagttctgggaggtgatctctgatgaacattgcatcgactccgtgactacacggngacngcanctgccggtgaccagttaaggcacaacggcagcagggtgacccgcctgacgacgtaccgtcacagcacactagtgcacaacgctgctccctcgatcaacactataccaacatgtgtcaacttacaaccacacatgccaaacacatatcctaaagatattgcaacataacaccgatagcaaaacataaagctaaggacacaacactcacacacattgca

SEQ ID NO: 73266 - DNA, 476 bp, Homo sapiens
gtttaaggcattctcaccaccacaaatggctgtggcagtacattcacatttatagttgtcagggcatttatagttggttagggacttgtcctttataaaactacttcaaccaatcttgctctcatctttcttttgattttgggttacttttttacattagagactaaatgtaggctaatggatgagacttcagggagaaacagaaaatgggaagttttaatcagggttgtaagctgaaaggaatattttaacttgaattgcccagtataaatatacatagataaaccaaaagcaaaaaagatttggaacctctctatttgctgcatttatgcataagaaagcctagctaaaatcagattctcttatcaacagtaatctatatgcttttcccaattaaaagaactttaacactccagtgggtgttgtgatgaatgactactgatatcattcaaccacattaattcacccaatatgtc

SEQ ID NO: 73267 - DNA, 267 bp, Homo sapiens
gcggccgcctactactactactactgctcgaattcaagcttctaacgatgtacggggtcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaa

SEQ ID NO: 73268 - DNA, 1017 bp, Homo sapiens
gcccttttctcggggcgcccgagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccaccggtcccggcctcggggggggctcactgaaccacgtcgcttttcgcaggtgccgcgtcggtaacgattagcccgacataagagctccgcgtgaaactttcactacggcgggatgccggacaacagctctatatcacgg

SEQ ID NO: 73269 - DNA, 530 bp, Homo sapiens
  misc_feature (11)..(11): n is a, c, g, or t
  misc_feature (13)..(14): n is a, c, g, or t
  misc_feature (17)..(17): n is a, c, g, or t
gcacagaaatnanntcntaggtgcgaggcctgggtgttgagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgagtctgcctcccacttggccccaagccatcctgcccttctctctgggtgctggcgggggt

SEQ ID NO: 73270 - DNA, 2289 bp, Homo sapiens
  misc_feature (2208)..(2208): n is a, c, g, or t
gcccttttctcggggcgcccgagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaaaaaaaaaanaaaaaaaaaaaaaaaaaaaatttggggggggtggggccggggaaaagtttttaaaaaatttggtgggggggggggcccagt

SEQ ID NO: 73271 - DNA, 2634 bp, Homo sapiens
  misc_feature (2208)..(2208): n is a, c, g, or t
  misc_feature (2272)..(2272): n is a, c, g, or t
  misc_feature (2288)..(2288): n is a, c, g, or t
  misc_feature (2299)..(2299): n is a, c, g, or t
  misc_feature (2303)..(2303): n is a, c, g, or t
  misc_feature (2307)..(2307): n is a, c, g, or t
  misc_feature (2492)..(2492): n is a, c, g, or t
gcccttttctcggggcgcccgagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaaaaaaaaaanaaaaaaaaaaaaaaaaaaaaaaaaaaaaaaaaaaaaaaaaaaaaaaaaaaaaaaaaaaaaaaanaaaaaaaaaaaaaaanaaataaaaaanaaanaaanaaaaatataattaaatttttatatatttaaaatttatattttatttttaatttaatttatataaatattaaaatttaattaattattttttttattatttttttatctatttttttttttttaaaaaatttttttttttattttatttattttattaattttttaattaatataatcttttttanttatttattaacattattaaaattttttttttttaaatattttttttaataaaaatttttatattattcattattttttttttaaattcttttcttccccatttctctctctctttctcatctatctttcctttctcctctc

SEQ ID NO: 73272 - DNA, 2475 bp, Homo sapiens
gcccttttctcggggcgcccgagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaaactatttatgagttcttttggtgtgaagaaagggctcatgttgcatttccagccattgctacaaagaacctttatttgttcagtaacggtagaaaatccttcccgattaaaaacttcagacttgctgaatatcctgcaatgtcaagatgaccgatgttgagttgggtggatttgctaacgagtcagatttgaacatgaggctattggaacccaataggcgtcattgatggcggcaagccatagctttcaagttttaataaaatgcacaaaagagaa

SEQ ID NO: 73273 - DNA, 2699 bp, Homo sapiens
gcccttttctcggggcgcccgagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaaactatttatgagttcttttggtgtgaagaaagggctcatgttgcatttccagccattgctacaaagaacctttatttgttcagtaacggtagaaaatccttcccgattaaaaacttcagacttgctgaatatcctgcaatgtcaagatgaccgatgttgagttgggtggatttgctaacgagtcagatttgaacatgaggctattggaacccaataggcgtcattgatggcggcaagccatagctttcaagttttaataaaatgcacaaaagagaaacaacaacagccaaaaaccattttgttgggcccgcatggcgcccttaaagagagtgtttgaacacattccgttgggcgccggcccattaggttgtggaacgtgtgccaggccggtcccagagaaaacccgggcctgacactgggtctgggttttcccccataaaaaagcccggggaaccggggtttgtgacacccgatgggtccggggccctccgggtcttacg

SEQ ID NO: 73274 - DNA, 2645 bp, Homo sapiens
gcccttttctcggggcgcccgagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaaactatttatgagttcttttggtgtgaagaaagggctcatgttgcatttccagccattgctacaaagaacctttatttgttcagtaacggtagaaaatccttcccgatttgggtggatttgctaacgagtcagatttgaacatgaggctattggaacccaataggcgtcattgatggcggcaagccatagctttcaagttttaataaaatgcacaaaagagaaacaacaacagccaaaaaccattttgttgggcccgcatggcgcccttaaagagagtgtttgaacacattccgttgggcgccggcccattaggttgtggaacgtgtgccaggccggtcccagagaaaacccgggcctgacactgggtctgggttttcccccataaaaaagcccggggaaccggggtttgtgacacccgatgggtccggggccctccgggtcttacg

SEQ ID NO: 73275 - DNA, 2589 bp, Homo sapiens
  misc_feature (2227)..(2227): n is a, c, g, or t
  misc_feature (2243)..(2243): n is a, c, g, or t
  misc_feature (2254)..(2254): n is a, c, g, or t
  misc_feature (2258)..(2258): n is a, c, g, or t
  misc_feature (2262)..(2262): n is a, c, g, or t
  misc_feature (2447)..(2447): n is a, c, g, or t
gcccttttctcggggcgcccgagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaaaaaaaaaaaaaaaaaaaaaaaaaaaaanaaaaaaaaaaaaaaanaaataaaaaanaaanaaanaaaaatataattaaatttttatatatttaaaatttatattttatttttaatttaatttatataaatattaaaatttaattaattattttttttattatttttttatctatttttttttttttaaaaaatttttttttttattttatttattttattaattttttaattaatataatcttttttanttatttattaacattattaaaattttttttttttaaatattttttttaataaaaatttttatattattcattattttttttttaaattcttttcttccccatttctctctctctttctcatctatctttcctttctcctctc

SEQ ID NO: 73276 - DNA, 2217 bp, Homo sapiens
  misc_feature (11)..(11): n is a, c, g, or t
  misc_feature (13)..(14): n is a, c, g, or t
  misc_feature (17)..(17): n is a, c, g, or t
gcacagaaatnanntcntaggtgcgaggcctgggtgttgagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaa

SEQ ID NO: 73277 - DNA, 2158 bp, Homo sapiens
gcccttttctcggggcgcccgagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgccaaattaaacaatacttgggatacaccaaccaat

SEQ ID NO: 73278 - DNA, 2200 bp, Homo sapiens
gcccttttctcggggcgcccgagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttacacagacataacagcgacataatgcttgttattaactgcatttgaagggaggagaaaaaaattcaaccgacgaacgg

SEQ ID NO: 73279 - DNA, 2157 bp, Homo sapiens
aaggagggacgcgtctgcagcaaaggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaa

SEQ ID NO: 73280 - DNA, 2380 bp, Homo sapiens
gcccttttctcggggcgcccgagaggccagctcagacctcccggctcgacaggcggcgcgggcggcggagttgaatccccctgggggttttcaagttgttcttggactgctggtttttgaaatagaagcccctttggtggggtcccccataaacccaggcgctggtgcccaccttgtgatgtgaaggctcctgtaacacgacctcactttcctggccccgcactactcacctgccccacgggacacaggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaa

SEQ ID NO: 73281 - DNA, 2163 bp, Homo sapiens
ggcggacgggtggggctggcaccgagaggcaggggcaggataggagagtgggggagacaccaggtccgcgccaggcgtctcggggcatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaa

SEQ ID NO: 73282 - DNA, 1651 bp, Homo sapiens
gcccttttctcggggcgcccgagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaccaaaaactcgagactagttctaaactcgtgccgctaaagc

SEQ ID NO: 73283 - DNA, 1675 bp, Homo sapiens
gcccttttctcggggcgcccgagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaaatttggggggggtggggccggggaaaagtttttaaaaaatttggtgggggggggggcccagt

SEQ ID NO: 73284 - DNA, 2216 bp, Homo sapiens
acactctcgggtccggggtccgcatgaggaggaaaagagtgagtaatggtagcgtcaccaggggcgcggggactgcctcctatcagctgataacctagtgtcatgatagcagtagccgctgaggagtaaaggcacgattaatatgaaccaattacgatccatctcgacataccaactaatgtcgcgtagggcccgaacgtacggtgagcggagatactctggacacgcgatggtcatgcggcttcctatgtggcttcccatgatgcctgtgaagctacattacctgagtgacgtaggcgacattacagagcaaacgtggcttcacggagtcgatctcgatttaacgctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaa

SEQ ID NO: 73285 - DNA, 2047 bp, Homo sapiens
cacgcgcagcatagcagagtcgacactagaggcatccaaagaataccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaagtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaa

SEQ ID NO: 73286 - DNA, 1351 bp, Homo sapiens
atgataggccgcgggttaatcggacgagggtcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaa

SEQ ID NO: 73287 - DNA, 1454 bp, Homo sapiens
gcccttttctcggggcgcccgagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaaacacctcgagagatcctctagatcagcca

SEQ ID NO: 73288 - DNA, 1051 bp, Homo sapiens
gacccacgcgtccgcggacgcgtgggtcgacccacgcgtccgtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaa

SEQ ID NO: 73289 - DNA, 837 bp, Homo sapiens
gtatttttagtagagacggggtttcaccgtgttagccaggatggtctcgatctcctgacctcactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaa

SEQ ID NO: 73290 - DNA, 810 bp, Homo sapiens
agtgcagtagcacgatcccggctcactgcaacctccctcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaa

SEQ ID NO: 73291 - DNA, 791 bp, Homo sapiens
ggcataagctaccatgctgggcctgcaatcccagcacttcgggaggccaaggcagaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaa

SEQ ID NO: 73292 - DNA, 492 bp, Homo sapiens
tcgagctcggcccgcgtatccgcataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaa

SEQ ID NO: 73293 - DNA, 634 bp, Homo sapiens
gccgaatttcgcacgagctcgtgccgttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaaactatttatgagttcttttggtgtgaagaaagggctcatgttgcatttccagccattgctacaaagaacctttatttgttcagtaacggtagaaaatccttcccgattaaaaacttcagacttgctgaatatcctgcaatgtcaagatgaccgatgttgagttgggtggatttgctaacgagtcagatttgaacatgaggctattggaacccaataggcgtcattgatggcggcaagccatagctttcaagttttaataaaatgcacaaaagagaa

SEQ ID NO: 73294 - DNA, 529 bp, Homo sapiens
cctcttcctagcttttggacaaagctggatggaagtcattttctcagaatttctgtttgccagaaagaaaattgaagacttaggtgaaaaagagagggagagatcaactgaatttcttatctggtatgttctgtttctgttttaggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaagtacgtgtggcctcccaggccccccttaccattccttggccttccaccctgggaatcaggagagtgaccgaagtgactctgccaaagagtctaagtgaagtgccagtacgttccagttttacccccttaccttgaaattccacacgcagtcttttagat

SEQ ID NO: 73295 - DNA, 841 bp, Homo sapiens
  misc_feature (11)..(11): n is a, c, g, or t
  misc_feature (13)..(14): n is a, c, g, or t
  misc_feature (17)..(17): n is a, c, g, or t
gcacagaaatnanntcntaggtgcgaggcctgggtgttgagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccctggtgcagcccgtccgcccctgaccggccgcctaatgtattgccaa

SEQ ID NO: 73296 - DNA, 2199 bp, Homo sapiens
gcccttttctcggggcgcccgagaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaa

SEQ ID NO: 73297 - DNA, 2360 bp, Homo sapiens
gtttctctccctgcccccgcgacttcgcgcaagatccgggaaggacacccgaggcccctgggagaccctggggaggtgaaagtcagagagcgaagcgggccgtggcccctaggcctgacccctccccgcggggtaaggcgggcaccccgcgagcgcaggggtcctcttactgctgatggcacccagctctgggcccagacgccgctcaccgtccaccgccggtgctgggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaa

SEQ ID NO: 73298 - DNA, 2450 bp, Homo sapiens
  misc_feature (2369)..(2369): n is a, c, g, or t
gtttctctccctgcccccgcgacttcgcgcaagatccgggaaggacacccgaggcccctgggagaccctggggaggtgaaagtcagagagcgaagcgggccgtggcccctaggcctgacccctccccgcggggtaaggcgggcaccccgcgagcgcaggggtcctcttactgctgatggcacccagctctgggcccagacgccgctcaccgtccaccgccggtgctgggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaaaaaaaaaanaaaaaaaaaaaaaaaaaaaatttggggggggtggggccggggaaaagtttttaaaaaatttggtgggggggggggcccagt

SEQ ID NO: 73299 - DNA, 2204 bp, Homo sapiens
cacgcgcagcatagcagagtcgacactagaggcatccaaagaataccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaa

SEQ ID NO: 73300 - DNA, 2217 bp, Homo sapiens
ggcggacgggtggggctggcaccgagaggcaggggcaggataggagagtgggggagacaccaggtccgcgccaggcgtctcgggggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaa

SEQ ID NO: 73301 - DNA, 2182 bp, Homo sapiens
tcaggctgtacggccccgggtttatggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaa

SEQ ID NO: 73302 - DNA, 2250 bp, Homo sapiens
acatgcccgaaggcacagagagtgtcttggtctgtccggacgcgtctgtagagttacaggaagagaagggccgccctccagagggccgggagcgccccagcgcgggtccggggtcgaggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaatttttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaa

SEQ ID NO: 73303 - DNA, 832 bp, Homo sapiens
gctgcgagggggaaactggggaaagggcctaattccccagtctccacctcgaatcaggaaagagaaggggcgggctgctgggcaaaagaggtgaagtgtccggacgcaccctcatcgacattggttcaggccccaccgtgtaccagctgctcagtgcctgcagccactttgaggacatcaccatgacagatttcctggaggtcaaccgccaggagctggggcgctggctgcaggaggagccgggggccttcaactggagcatgtacagccaacatgcctgcctcattgagggcaagggggaatgctggcaggataaggagcgccagctgcgagccagggtgaaacgggtcctgcccatcgacgtgcaccagccccagcccctgggtgctgggagcccagctcccctgcctgctgacgccctggtctctgccttctgcttggaggctgtgagcccagatcttgccagctttcagcgggccctggaccacatcaccacgctgctgaggcctggggggcacctcctcctcatcggggccctggaggagtcgtggtacctggctggggaggccaggctgacggtggtgccagtgtctgaggaggaggtgagggaggccctggtgcgtagtggctacaaggtccgggacctccgcacctatatcatgcctgcccaccttcagacaggcgtagatgatgtcaagggcgtcttcttcgcctgggctcagaaggttgggctgtgagggctgtacctggtgccctgtggcccccacccacctggattccctgttctttgaagtggcacctaataaagaaataataccctgccgctgcggtc

SEQ ID NO: 73304 - DNA, 593 bp, Homo sapiens
ctccgcaacaactacgcgccccctcgcggggacctgtgcaacccgaacggcgtcgggccgtggaagctgcgctgcttggcgcagaccttcgccaccggtgagcgggggaaactgaggcacgagggacaagaggtcgtcggggagtgaaagcaggcgcagggaaataaaaagaaggaaagggagacagaccaggcgcctaacagatggggaccaagaaacaagagatagctgagaggtgcaaacagaagagaaaaaggagcaacatcccttaggagaggggcagaggagagagaggtggagagagggggcggagagtgctcagaattgagagctaaggtgggggatgcaggacagactgaggtggagatgcataggaggaaatggaggcagatgtgggacaggggtgagaaactgccaggatttcctcgctgagcctggctggtaggtatagttgttttctttctttttctttattttattttcatttatttacttatttttattttttatttgttttgagacggagtttcgctcttgttgcccaggctggagtacaatggcgccatctcggctcactgcaacctccgcctccc

SEQ ID NO: 73305 - DNA, 1166 bp, Homo sapiens
ggacgattgccgctgcagccgccgccccactcacctccggtgtgtctgcagcccggacactaagggagatggatgaatgggtggggaggatgcggcgcacatggccccgggcggctcggcggtcagctgccgcccccacagcggaccggtcggggcgggggtcgggcggtagaaaaaagggccgcgaggcgagcggggcactgggcggaccgcggcggcagcatgagcggcgcagaccgtagccccaatgcgggcgcagcccctgactcggccccgggccaggcggcggtggcttcggcctaccagcgcttcgagccgcgcgcctacctccgcaacaactacgcgccccctcgcggggacctgtgcaacccgaacggcgtcgggccgtggaagctgcgctgcttggcgcagaccttcgccaccggtgaagtgtccggacgcaccctcatcgacattggttcaggccccaccgtgtaccagctgctcagtgcctgcagccactttgaggacatcaccatgacagatttcctggaggtcaaccgccaggagctggggcgctggctgcaggaggagccgggggccttcaactggagcatgtacagccaacatgcctgcctcattgagggcaagggggaatgctggcaggataaggagcgccagctgcgagccagggtgaaacgggtcctgcccatcgacgtgcaccagccccagcccctgggtgctgggagcccagctcccctgcctgctgacgccctggtctctgccttctgcttggaggctgtgagcccagatcttgccagctttcagcgggccctggaccacatcaccacgctgctgaggcctggggggcacctcctcctcatcggggccctggaggagtcgtggtacctggctggggaggccaggctgacggtggtgccagtgtctgaggaggaggtgagggaggccctggtgcgtagtggctacaaggtccgggacctccgcacctatatcatgcctgcccaccttcagacaggcgtagatgatgtcaagggcgtcttcttcgcctgggctcagaaggttgggctgtgagggctgtacctggtgccctgtggcccccacccacctggattccctgttctttgaagtggcacctaataaagaaataataccctgccgctgcggtc

SEQ ID NO: 73306 - DNA, 1280 bp, Homo sapiens
ggacgattgccgctgcagccgccgccccactcacctccggtgtgtctgcagcccggacactaagggagatggatgaatgggtggggaggatgcggcgcacatggccccgggcggctcggcggtcagctgccgcccccacagcggaccggtcggggcgggggtcgggcggtagaaaaaagggccgcgaggcgagcggggcactgggcggaccgcggcggcagcatgagcggcgcagaccgtagccccaatgcgggcgcagcccctgactcggccccgggccaggcggcggtggcttcggcctaccagcgcttcgagccgcgcgcctacctccgcaacaactacgcgccccctcgcggggacctgtgcaacccgaacggcgtcgggccgtggaagctgcgctgcttggcgcagaccttcgccaccggtgaagtgtccggacgcaccctcatcgacattggttcaggccccaccgtgtaccagctgctcagtgcctgcagccactttgaggacatcaccatgacagatttcctggaggtcaaccgccaggagctggggcgctggctgcaggaggagccgggggccttcaactggagcatgtacagccaacatgcctgcctcattgagggcaaggggtaaggactggggggtgagggttggggaggaggcttcccatagagtggctggttggggcaacagaggcctgagcgtagaacagccttgagccctgccttgtgcctcctgcacagggaatgctggcaggataaggagcgccagctgcgagccagggtgaaacgggtcctgcccatcgacgtgcaccagccccagcccctgggtgctgggagcccagctcccctgcctgctgacgccctggtctctgccttctgcttggaggctgtgagcccagatcttgccagctttcagcgggccctggaccacatcaccacgctgctgaggcctggggggcacctcctcctcatcggggccctggaggagtcgtggtacctggctggggaggccaggctgacggtggtgccagtgtctgaggaggaggtgagggaggccctggtgcgtagtggctacaaggtccgggacctccgcacctatatcatgcctgcccaccttcagacaggcgtagatgatgtcaagggcgtcttcttcgcctgggctcagaaggttgggctgtgagggctgtacctggtgccctgtggcccccacccacctggattccctgttctttgaagtggcacctaataaagaaataataccctgccgctgcggtc

SEQ ID NO: 73307 - DNA, 464 bp, Homo sapiens
tactactactagattcgcggccgcgtcgaccttgtttaatgaagaaaaatgcttggggtggaagggactcttgagatttcaccagagactttttctttttaataaatcaaaccttttgatgatttgaggttttatctgcagttttggaagcagtcacaaatgagacctgttataaggtggtatttttttttttcttctggacagtatttaaaggatcttattcttatttcccagggaaattctgggctcccacaaagtaaaaaaaaaaaaaaatcatagaaaaagaatgagcaggaatagttcttattccagaattgtacagtattcaccttaagttgattttttttctccttctgcaattgaactgaatacatttttcatgcatgttttccagaaaatagaagtattaatgttattaaaaagattattttttttattaaaggctatttatattatagaaacta

SEQ ID NO: 73308 - DNA, 4300 bp, Homo sapiens
  misc_feature (15)..(15): n is a, c, g, or t
  misc_feature (23)..(23): n is a, c, g, or t
  misc_feature (27)..(27): n is a, c, g, or t
  misc_feature (30)..(30): n is a, c, g, or t
  misc_feature (59)..(59): n is a, c, g, or t
  misc_feature (64)..(64): n is a, c, g, or t
  misc_feature (86)..(86): n is a, c, g, or t
  misc_feature (90)..(90): n is a, c, g, or t
  misc_feature (354)..(354): n is a, c, g, or t
ggaggcgggggcgtngcgcctcntccntcntccctcggcgccgctgccgcccccgcggngtggngacccgagtgcggttagagccngganctggaagagccccgagcgtttctgctttgggacaaccatacatctaattccttaaagtagttttatatgtaaaacttgcaaagaatcagaacaatgcctccaagaccatcatcaggtgaactgtggggcatccacttgatgcccccaagaatcctagtagaatgtttactaccaaatggaatgatagtgactttagaatgcctccgtgaggctacattaataaccataaagcatgaactatttaaagaagcaagaaaatacccnctccatcaacttcttcaagatgaatcttcttacattttcgtaagtgttacccaagaagcagaaagggaagaattttttgatgaaacaagacgactttgtgaccttcggctttttcaaccctttttaaaagtaattgaaccagtaggcaaccgtgaagaaaagatcctcaatcgagaaattggttttgctatcggcatgccagtgtgtgaatttgatatggttaaagatccagaagtacaggacttccgaagaaatattctgaacgtttgtaaagaagctgtggatcttagggacctcaattcacctcatagtagagcaatgtatgtctatcctccaaatgtagaatcttcaccagaattgccaaagcacatatataataaattagataaagggcaaataatagtggtgatctgggtaatagtttctccaaataatgacaagcagaagtatactctgaaaatcaaccatgactgtgtaccagaacaagtaattgctgaagcaatcaggaaaaaaactcgaagtatgttgctatcctctgaacaactaaaactctgtgttttagaatatcagggcaagtatattttaaaagtgtgtggatgtgatgaatacttcctagaaaaatatcctctgagtcagtataagtatataagaagctgtataatgcttgggaggatgcccaatttgatgttgatggctaaagaaagcctttattctcaactgccaatggactgttttacaatgccatcttattccagacgcatttccacagctacaccatatatgaatggagaaacatctacaaaatccctttgggttataaatagtgcactcagaataaaaattctttgtgcaacctacgtgaatgtaaatattcgagacattgataagatctatgttcgaacaggtatctaccatggaggagaacccttatgtgacaatgtgaacactcaaagagtaccttgttccaatcccaggtggaatgaatggctgaattatgatatatacattcctgatcttcctcgtgctgctcgactttgcctttccatttgctctgttaaaggccgaaagggtgctaaagaggaacactgtccattggcatggggaaatataaacttgtttgattacacagacactctagtatctggaaaaatggctttgaatctttggccagtacctcatggattagaagatttgctgaaccctattggtgttactggatcaaatccaaataaagaaactccatgcttagagttggagtttgactggttcagcagtgtggtaaagttcccagatatgtcagtgattgaagagcatgccaattggtctgtatcccgagaagcaggatttagctattcccacgcaggactgagtaacagactagctagagacaatgaattaagggaaaatgacaaagaacagctcaaagcaatttctacacgagatcctctctctgaaatcactgagcaggagaaagattttctatggagtcacagacactattgtgtaactatccccgaaattctacccaaattgcttctgtctgttaaatggaattctagagatgaagtagcccagatgtattgcttggtaaaagattggcctccaatcaaacctgaacaggctatggaacttctggactgtaattacccagatcctatggttcgaggttttgctgttcggtgcttggaaaaatatttaacagatgacaaactttctcagtatttaattcagctagtacaggtcctaaaatatgaacaatatttggataacttgcttgtgagatttttactgaagaaagcattgactaatcaaaggattgggcactttttcttttggcatttaaaatctgagatgcacaataaaacagttagccagaggtttggcctgcttttggagtcctattgtcgtgcatgtgggatgtatttgaagcacctgaataggcaagtcgaggcaatggaaaagctcattaacttaactgacattctcaaacaggagaagaaggatgaaacacaaaaggtacagatgaagtttttagttgagcaaatgaggcgaccagatttcatggatgctctacagggctttctgtctcctctaaaccctgctcatcaactaggaaacctcaggcttgaagagtgtcgaattatgtcctctgcaaaaaggccactgtggttgaattgggagaacccagacatcatgtcagagttactgtttcagaacaatgagatcatctttaaaaatggggatgatttacggcaagatatgctaacacttcaaattattcgtattatggaaaatatctggcaaaatcaaggtcttgatcttcgaatgttaccttatggttgtctgtcaatcggtgactgtgtgggacttattgaggtggtgcgaaattctcacactattatgcaaattcagtgcaaaggcggcttgaaaggtgcactgcagttcaacagccacacactacatcagtggctcaaagacaagaacaaaggagaaatatatgatgcagccattgacctgtttacacgttcatgtgctggatactgtgtagctaccttcattttgggaattggagatcgtcacaatagtaacatcatggtgaaagacgatggacaactgtttcatatagattttggacactttttggatcacaagaagaaaaaatttggttataaacgagaacgtgtgccatttgttttgacacaggatttcttaatagtgattagtaaaggagcccaagaatgcacaaagacaagagaatttgagaggtttcaggagatgtgttacaaggcttatctagctattcgacagcatgccaatctcttcataaatcttttctcaatgatgcttggctctggaatgccagaactacaatcttttgatgacattgcatacattcgaaagaccctagccttagataaaactgagcaagaggctttggagtatttcatgaaacaaatgaatgatgcacatcatggtggctggacaacaaaaatggattggatcttccacacaattaaacagcatgcattgaactgaaaagataactgagaaaatgaaagctcactctggattccacactgcactgttaataactctcagcaggcaaagaccgattgcataggaattgcacaatccatgaacagcattagaatttacagcaagaacagaaataaaatactatataatttaaataatgtaaacgcaaacagggtttgatagcacttaaactagttcatttcaaaattaagctttagaataatgcgcaatttcatgttatgccttaagtccaaaaaggtaaactttgaagattgtttgtatctttttttaaaaaacaaaacaaaacaaaaatccccaaaatatatagaaatgatggagaaggaaaaagtgatggttttttttgtcttgcaaatgttctatgttttgaaatgtggacacaacaaaggctgttattgcattaggtgtaagtaaactggagtttatgttaaattacattgattggaaaagaatgaaaatttcttatttttccattgctgttcaatttatagtttgaagtgggtttttgactgcttgtttaatgaagataataaatcaaaccttttgatgatttgaggttttatctgcagttttggaagcagtcacaaatgagacctgttataaggtggtatttttttttttcttctggacagtatttaaaggatcttattcttatttcccagggaaattctgggctcccacaaagtaaaaaaaaaaaaaaatcatagaaaaagaatgagcaggaatagttcttattccagaattgtacagtattcaccttaagttgattttttttctccttctgcaattgaactgaatacatttttcatgcatgttttccagaaaatagaagtattaatgttattaaaaagattattttttttattaaaggctatttatattatagaaacta

SEQ ID NO: 73309 - DNA, 4300 bp, Homo sapiens
  misc_feature (15)..(15): n is a, c, g, or t
  misc_feature (23)..(23): n is a, c, g, or t
  misc_feature (27)..(27): n is a, c, g, or t
  misc_feature (30)..(30): n is a, c, g, or t
  misc_feature (59)..(59): n is a, c, g, or t
  misc_feature (64)..(64): n is a, c, g, or t
  misc_feature (86)..(86): n is a, c, g, or t
  misc_feature (90)..(90): n is a, c, g, or t
  misc_feature (354)..(354): n is a, c, g, or t
ggaggcgggggcgtngcgcctcntccntcntccctcggcgccgctgccgcccccgcggngtggngacccgagtgcggttagagccngganctggaagagccccgagcgtttctgctttgggacaaccatacatctaattccttaaagtagttttatatgtaaaacttgcaaagaatcagaacaatgcctccaagaccatcatcaggtgaactgtggggcatccacttgatgcccccaagaatcctagtagaatgtttactaccaaatggaatgatagtgactttagaatgcctccgtgaggctacattaataaccataaagcatgaactatttaaagaagcaagaaaatacccnctccatcaacttcttcaagatgaatcttcttacattttcgtaagtgttacccaagaagcagaaagggaagaattttttgatgaaacaagacgactttgtgaccttcggctttttcaaccctttttaaaagtaattgaaccagtaggcaaccgtgaagaaaagatcctcaatcgagaaattggttttgctatcggcatgccagtgtgtgaatttgatatggttaaagatccagaagtacaggacttccgaagaaatattctgaacgtttgtaaagaagctgtggatcttagggacctcaattcacctcatagtagagcaatgtatgtctatcctccaaatgtagaatcttcaccagaattgccaaagcacatatataataaattagataaagggcaaataatagtggtgatctgggtaatagtttctccaaataatgacaagcagaagtatactctgaaaatcaaccatgactgtgtaccagaacaagtaattgctgaagcaatcaggaaaaaaactcgaagtatgttgctatcctctgaacaactaaaactctgtgttttagaatatcagggcaagtatattttaaaagtgtgtggatgtgatgaatacttcctagagatgcccaatttgatgttgatggctaaagaaagcctttattctcaactgccaatggactgttttacaatgccatcttattccagacgcatttccacagctacaccatatatgaatggagaaacatctacaaaatccctttgggttataaatagtgcactcagaataaaaattctttgtgcaacctacgtgaatgtaaatattcgagacattgataagatctatgttcgaacaggtatctaccatggaggagaacccttatgtgacaatgtgaacactcaaagagtaccttgttccaatcccaggtggaatgaatggctgaattatgatatatacattcctgatcttcctcgtgctgctcgactttgcctttccatttgctctgttaaaggccgaaagggtgctaaagaggaacactgtccattggcatggggaaatataaacttgtttgattacacagacactctagtatctggaaaaatggctttgaatctttggccagtacctcatggattagaagatttgctgaaccctattggtgttactggatcaaatccaaataaagaaactccatgcttagagttggagtttgactggttcagcagtgtggtaaagttcccagatatgtcagtgattgaagagcatgccaattggtctgtatcccgagaagcaggatttagctattcccacgcaggactgagtaacagactagctagagacaatgaattaagggaaaatgacaaagaacagctcaaagcaatttctacacgagatcctctctctgaaatcactgagcaggagaaagattttctatggagtcacagacactattgtgtaactatccccgaaattctacccaaattgcttctgtctgttaaatggaattctagagatgaagtagcccagatgtattgcttggtaaaagattggcctccaatcaaacctgaacaggctatggaacttctggactgtaattacccagatcctatggttcgaggttttgctgttcggtgcttggaaaaatatttaacagatgacaaactttctcagtatttaattcagctagtacaggtcctaaaatatgaacaatatttggataacttgcttgtgagatttttactgaagaaagcattgactaatcaaaggattgggcactttttcttttggcatttaaaatctgagatgcacaataaaacagttagccagaggtttggcctgcttttggagtcctattgtcgtgcatgtgggatgtatttgaagcacctgaataggcaagtcgaggcaatggaaaagctcattaacttaactgacattctcaaacaggagaagaaggatgaaacacaaaaggtacagatgaagtttttagttgagcaaatgaggcgaccagatttcatggatgctctacagggctttctgtctcctctaaaccctgctcatcaactaggaaacctcaggcttgaagagtgtcgaattatgtcctctgcaaaaaggccactgtggttgaattgggagaacccagacatcatgtcagagttactgtttcagaacaatgagatcatctttaaaaatggggatgatttacggcaagatatgctaacacttcaaattattcgtattatggaaaatatctggcaaaatcaaggtcttgatcttcgaatgttaccttatggttgtctgtcaatcggtgactgtgtgggacttattgaggtggtgcgaaattctcacactattatgcaaattcagtgcaaaggcggcttgaaaggtgcactgcagttcaacagccacacactacatcagtggctcaaagacaagaacaaaggagaaatatatgatgcagccattgacctgtttacacgttcatgtgctggatactgtgtagctaccttcattttgggaattggagatcgtcacaatagtaacatcatggtgaaagacgatggacaactgtttcatatagattttggacactttttggatcacaagaagaaaaaatttggttataaacgagaacgtgtgccatttgttttgacacaggatttcttaatagtgattagtaaaggagcccaagaatgcacaaagacaagagaatttgagaggtttcaggagatgtgttacaaggcttatctagctattcgacagcatgccaatctcttcataaatcttttctcaatgatgcttggctctggaatgccagaactacaatcttttgatgacattgcatacattcgaaagaccctagccttagataaaactgagcaagaggctttggagtatttcatgaaacaaatgaatgatgcacatcatggtggctggacaacaaaaatggattggatcttccacacaattaaacagcatgcattgaactgaaaagataactgagaaaatgaaagctcactctggattccacactgcactgttaataactctcagcaggcaaagaccgattgcataggaattgcacaatccatgaacagcattagaatttacagcaagaacagaaataaaatactatataatttaaataatgtaaacgcaaacagggtttgatagcacttaaactagttcatttcaaaattaagctttagaataatgcgcaatttcatgttatgccttaagtccaaaaaggtaaactttgaagattgtttgtatctttttttaaaaaacaaaacaaaacaaaaatccccaaaatatatagaaatgatggagaaggaaaaagtgatggttttttttgtcttgcaaatgttctatgttttgaaatgtggacacaacaaaggctgttattgcattaggtgtaagtaaactggagtttatgttaaattacattgattggaaaagaatgaaaatttcttatttttccattgctgttcaatttatagtttgaagtgggtttttgactgcttgtttaatgaagaaaaatgcttggggtggaagggactcttgagatttcaccagagactttttctttttaataaatcaaaccttttgatgatttgaggttttatctgcagttttggaagcagtcacaaatgagacctgttataaggtggtatttttttttttcttctggacagtatttaaaggatcttattcttatttcccagggaaattctgggctcccacaaagtaaaaaaaaaaaaaaatcatagaaaaagaatgagcaggaatagttcttattccagaattgtacagtattcaccttaagttgattttttttctccttctgcaattgaactgaatacatttttcatgcatgttttccagaaaatagaagtattaatgttattaaaaagattattttttttattaaaggctatttatattatagaaacta

SEQ ID NO: 73310 - DNA, 2560 bp, Homo sapiens
ttgattttaatgtaactgagtatgaaaagtttattgatacagttttagattacattttgcaacttaagaaacttatcttgtcaggttttagaatagtaccaaagaaaaatatcacaattatctgaaaagtctattataatactccttctttttctacctacctatctttgtgaggccagattttctttttatactttaattaaaacattgcattagattgcatacaaaagcatatatgagaatccagctgggtactatgaagccagacatttaaaaatttttttaaatgtgaaagaatttcactcttctcactaaattttttaaatgcattttttgtttcatgaaatatgttacttatattaacatgtcatagtttgttgcttttaaatgaattagtaaatatttaaaatttttattttccctatttcaatttctaatatcattagatgtaattcacataactaaaagctctttggagtcctcagtaatttctacaagtgtaaaggagtcctgagaccaaaattgagaacttctgccctacagttttatttcgatgtcaattaaacatctttaaattaacacatatttttaaaatcataaatgtttgtaaaattttaattgccacaataattttcttaattcttttctgataaaaatacagtgctttctcagttgaaggttataataaatgatgacaggtaattttgaggattattccaggagtatgtttatcacaccataaaaaagaaaattaaaattggggaaaggcagtaaaggtcatgcatgacaaatttactaataaaatactcatgttttagcctgttaaaacatttgctattttaaaattccatcatttaattgtaaacgtgttactcctctttcagaatgttaccttatggttgtctgtcaatcggtgactgtgtgggacttattgaggtggtgcgaaattctcacactattatgcaaattcagtgcaaaggcggcttgaaaggtgcactgcagttcaacagccacacactacatcagtggctcaaagacaagaacaaaggagaaatatatgatgcagccattgacctgtttacacgttcatgtgctggatactgtgtagctaccttcattttgggaattggagatcgtcacaatagtaacatcatggtgaaagacgatggacaactgtttcatatagattttggacactttttggatcacaagaagaaaaaatttggttataaacgagaacgtgtgccatttgttttgacacaggatttcttaatagtgattagtaaaggagcccaagaatgcacaaagacaagagaatttgagaggtttcaggagatgtgttacaaggcttatctagctattcgacagcatgccaatctcttcataaatcttttctcaatgatgcttggctctggaatgccagaactacaatcttttgatgacattgcatacattcgaaagaccctagccttagataaaactgagcaagaggctttggagtatttcatgaaacaaatgaatgatgcacatcatggtggctggacaacaaaaatggattggatcttccacacaattaaacagcatgcattgaactgaaaagataactgagaaaatgaaagctcactctggattccacactgcactgttaataactctcagcaggcaaagaccgattgcataggaattgcacaatccatgaacagcattagaatttacagcaagaacagaaataaaatactatataatttaaataatgtaaacgcaaacagggtttgatagcacttaaactagttcatttcaaaattaagctttagaataatgcgcaatttcatgttatgccttaagtccaaaaaggtaaactttgaagattgtttgtatctttttttaaaaaacaaaacaaaacaaaaatccccaaaatatatagaaatgatggagaaggaaaaagtgatggttttttttgtcttgcaaatgttctatgttttgaaatgtggacacaacaaaggctgttattgcattaggtgtaagtaaactggagtttatgttaaattacattgattggaaaagaatgaaaatttcttatttttccattgctgttcaatttatagtttgaagtgggtttttgactgcttgtttaatgaagaaaaatgcttggggtggaagggactcttgagatttcaccagagactttttctttttaataaatcaaaccttttgatgatttgaggttttatctgcagttttggaagcagtcacaaatgagacctgttataaggtggtatttttttttttcttctggacagtatttaaaggatcttattcttatttcccagggaaattctgggctcccacaaagtaaaaaaaaaaaaaaatcatagaaaaagaatgagcaggaatagttcttattccagaattgtacagtattcaccttaagttgattttttttctccttctgcaattgaactgaatacatttttcatgcatgttttccagaaaatagaagtattaatgttattaaaaagattattttttttattaaaggctatttatattatagaaacta

SEQ ID NO: 73311 - DNA, 297 bp, Homo sapiens
tgcaaaggcggcttgaaaggtgcactgcagttcaacagccacacactacatcagtggctcaaagacaagaacaaaggagaaatgtgagttgtattattctttcttcctatgttaatctaagtttttgttagatgagtctgtcggtgtttgtgtattcctctgagttagaacagagaaaacaattgtactttctatggaaaaaaatatgctcaacctttgaaatatttgatgttaatggatttaaatgattataattacttttaatttggtaaaatcttaaacattcatcttatgtat

SEQ ID NO: 73312 - DNA, 151 bp, Homo sapiens
gtgtcgaattatgtcctctgcaaaaaggccactgtggttgaattgggagaacccagacatcatgtcagagttactgtttcagaacaatgagatcatctttaaaaatggggatggtaaggaagagtattaatgagcttatgatgcatgaatt

SEQ ID NO: 73313 - DNA, 4354 bp, Homo sapiens
  misc_feature (15)..(15): n is a, c, g, or t
  misc_feature (23)..(23): n is a, c, g, or t
  misc_feature (27)..(27): n is a, c, g, or t
  misc_feature (30)..(30): n is a, c, g, or t
  misc_feature (59)..(59): n is a, c, g, or t
  misc_feature (64)..(64): n is a, c, g, or t
  misc_feature (86)..(86): n is a, c, g, or t
  misc_feature (90)..(90): n is a, c, g, or t
  misc_feature (354)..(354): n is a, c, g, or t
ggaggcgggggcgtngcgcctcntccntcntccctcggcgccgctgccgcccccgcggngtggngacccgagtgcggttagagccngganctggaagagccccgagcgtttctgctttgggacaaccatacatctaattccttaaagtagttttatatgtaaaacttgcaaagaatcagaacaatgcctccaagaccatcatcaggtgaactgtggggcatccacttgatgcccccaagaatcctagtagaatgtttactaccaaatggaatgatagtgactttagaatgcctccgtgaggctacattaataaccataaagcatgaactatttaaagaagcaagaaaatacccnctccatcaacttcttcaagatgaatcttcttacattttcgtaagtgttacccaagaagcagaaagggaagaattttttgatgaaacaagacgactttgtgaccttcggctttttcaaccctttttaaaagtaattgaaccagtaggcaaccgtgaagaaaagatcctcaatcgagaaattggttttgctatcggcatgccagtgtgtgaatttgatatggttaaagatccagaagtacaggacttccgaagaaatattctgaacgtttgtaaagaagctgtggatcttagggacctcaattcacctcatagtagagcaatgtatgtctatcctccaaatgtagaatcttcaccagaattgccaaagcacatatataataaattagataaagggcaaataatagtggtgatctgggtaatagtttctccaaataatgacaagcagaagtatactctgaaaatcaaccatgactgtgtaccagaacaagtaattgctgaagcaatcaggaaaaaaactcgaagtatgttgctatcctctgaacaactaaaactctgtgttttagaatatcagggcaagtatattttaaaagtgtgtggatgtgatgaatacttcctagaaaaatatcctctgagtcagtataagtatataagaagctgtataatgcttgggaggatgcccaatttgatgttgatggctaaagaaagcctttattctcaactgccaatggactgttttacaatgccatcttattccagacgcatttccacagctacaccatatatgaatggagaaacatctacaaaatccctttgggttataaatagtgcactcagaataaaaattctttgtgcaacctacgtgaatgtaaatattcgagacattgataagatctatgttcgaacaggtatctaccatggaggagaacccttatgtgacaatgtgaacactcaaagagtaccttgttccaatcccaggtggaatgaatggctgaattatgatatatacattcctgatcttcctcgtgctgctcgactttgcctttccatttgctctgttaaaggccgaaagggtgctaaagaggaacactgtccattggcatggggaaatataaacttgtttgattacacagacactctagtatctggaaaaatggctttgaatctttggccagtacctcatggattagaagatttgctgaaccctattggtgttactggatcaaatccaaataaagaaactccatgcttagagttggagtttgactggttcagcagtgtggtaaagttcccagatatgtcagtgattgaagagcatgccaattggtctgtatcccgagaagcaggatttagctattcccacgcaggactgagtaacagactagctagagacaatgaattaagggaaaatgacaaagaacagctcaaagcaatttctacacgagatcctctctctgaaatcactgagcaggagaaagattttctatggagtcacagacactattgtgtaactatccccgaaattctacccaaattgcttctgtctgttaaatggaattctagagatgaagtagcccagatgtattgcttggtaaaagattggcctccaatcaaacctgaacaggctatggaacttctggactgtaattacccagatcctatggttcgaggttttgctgttcggtgcttggaaaaatatttaacagatgacaaactttctcagtatttaattcagctagtacaggtcctaaaatatgaacaatatttggataacttgcttgtgagatttttactgaagaaagcattgactaatcaaaggattgggcactttttcttttggcatttaaaatctgagatgcacaataaaacagttagccagaggtttggcctgcttttggagtcctattgtcgtgcatgtgggatgtatttgaagcacctgaataggcaagtcgaggcaatggaaaagctcattaacttaactgacattctcaaacaggagaagaaggatgaaacacaaaaggtacagatgaagtttttagttgagcaaatgaggcgaccagatttcatggatgctctacagggctttctgtctcctctaaaccctgctcatcaactaggaaacctcaggcttgaagagtgtcgaattatgtcctctgcaaaaaggccactgtggttgaattgggagaacccagacatcatgtcagagttactgtttcagaacaatgagatcatctttaaaaatggggatgatttacggcaagatatgctaacacttcaaattattcgtattatggaaaatatctggcaaaatcaaggtcttgatcttcgaatgttaccttatggttgtctgtcaatcggtgactgtgtgggacttattgaggtggtgcgaaattctcacactattatgcaaattcagtgcaaaggcggcttgaaaggtgcactgcagttcaacagccacacactacatcagtggctcaaagacaagaacaaaggagaaatatatgatgcagccattgacctgtttacacgttcatgtgctggatactgtgtagctaccttcattttgggaattggagatcgtcacaatagtaacatcatggtgaaagacgatggacaactgtttcatatagattttggacactttttggatcacaagaagaaaaaatttggttataaacgagaacgtgtgccatttgttttgacacaggatttcttaatagtgattagtaaaggagcccaagaatgcacaaagacaagagaatttgagaggtttcaggagatgtgttacaaggcttatctagctattcgacagcatgccaatctcttcataaatcttttctcaatgatgcttggctctggaatgccagaactacaatcttttgatgacattgcatacattcgaaagaccctagccttagataaaactgagcaagaggctttggagtatttcatgaaacaaatgaatgatgcacatcatggtggctggacaacaaaaatggattggatcttccacacaattaaacagcatgcattgaactgaaaagataactgagaaaatgaaagctcactctggattccacactgcactgttaataactctcagcaggcaaagaccgattgcataggaattgcacaatccatgaacagcattagaatttacagcaagaacagaaataaaatactatataatttaaataatgtaaacgcaaacagggtttgatagcacttaaactagttcatttcaaaattaagctttagaataatgcgcaatttcatgttatgccttaagtccaaaaaggtaaactttgaagattgtttgtatctttttttaaaaaacaaaacaaaacaaaaatccccaaaatatatagaaatgatggagaaggaaaaagtgatggttttttttgtcttgcaaatgttctatgttttgaaatgtggacacaacaaaggctgttattgcattaggtgtaagtaaactggagtttatgttaaattacattgattggaaaagaatgaaaatttcttatttttccattgctgttcaatttatagtttgaagtgggtttttgactgcttgtttaatgaagaaaaatgcttggggtggaagggactcttgagatttcaccagagactttttctttttaataaatcaaaccttttgatgatttgaggttttatctgcagttttggaagcagtcacaaatgagacctgttataaggtggtatttttttttttcttctggacagtatttaaaggatcttattcttatttcccagggaaattctgggctcccacaaagtaaaaaaaaaaaaaaatcatagaaaaagaatgagcaggaatagttcttattccagaattgtacagtattcaccttaagttgattttttttctccttctgcaattgaactgaatacatttttcatgcatgttttccagaaaatagaagtattaatgttattaaaaagattattttttttattaaaggctatttatattatagaaacta

SEQ ID NO: 73314 - DNA, 1769 bp, Homo sapiens
  misc_feature (2)..(2): n is a, c, g, or t
  misc_feature (12)..(12): n is a, c, g, or t
  misc_feature (18)..(18): n is a, c, g, or t
  misc_feature (23)..(26): n is a, c, g, or t
  misc_feature (34)..(34): n is a, c, g, or t
cngtactagagnatcccngtcannnnctacaccnacacttcaaattattcgtattatggaaaatatctggcaaaatcaaggtcttgatcttcgaatgttaccttatggttgtctgtcaatcggtgactgtgtgggacttattgaggtggtgcgaaattctcacactattatgcaaattcagtgcaaaggcggcttgaaaggtgcactgcagttcaacagccacacactacatcagtggctcaaagacaagaacaaaggagaaatatatgatgcagccattgacctgtttacacgttcatgtgctggatactgtgtagctaccttcattttgggaattggagatcgtcacaatagtaacatcatggtgaaagacgatggacaactgtttcatatagattttggacactttttggatcacaagaagaaaaaatttggttataaacgagaacgtgtgccatttgttttgacacaggatttcttaatagtgattagtaaaggagcccaagaatgcacaaagacaagagaatttgagaggtttcaggagatgtgttacaaggcttatctagctattcgacagcatgccaatctcttcataaatcttttctcaatgatgcttggctctggaatgccagaactacaatcttttgatgacattgcatacattcgaaagaccctagccttagataaaactgagcaagaggctttggagtatttcatgaaacaaatgaatgatgcacatcatggtggctggacaacaaaaatggattggatcttccacacaattaaacagcatgcattgaactgaaaagataactgagaaaatgaaagctcactctggattccacactgcactgttaataactctcagcaggcaaagaccgattgcataggaattgcacaatccatgaacagcattagaatttacagcaagaacagaaataaaatactatataatttaaataatgtaaacgcaaacagggtttgatagcacttaaactagttcatttcaaaattaagctttagaataatgcgcaatttcatgttatgccttaagtccaaaaaggtaaactttgaagattgtttgtatctttttttaaaaaacaaaacaaaacaaaaatccccaaaatatatagaaatgatggagaaggaaaaagtgatggttttttttgtcttgcaaatgttctatgttttgaaatgtggacacaacaaaggctgttattgcattaggtgtaagtaaactggagtttatgttaaattacattgattggaaaagaatgaaaatttcttatttttccattgctgttcaatttatagtttgaagtgggtttttgactgcttgtttaatgaagaaaaatgcttggggtggaagggactcttgagatttcaccagagactttttctttttaataaatcaaaccttttgatgatttgaggttttatctgcagttttggaagcagtcacaaatgagacctgttataaggtggtatttttttttttcttctggacagtatttaaaggatcttattcttatttcccagggaaattctgggctcccacaaagtaaaaaaaaaaaaaaatcatagaaaaagaatgagcaggaatagttcttattccagaattgtacagtattcaccttaagttgattttttttctccttctgcaattgaactgaatacatttttcatgcatgttttccagaaaatagaagtattaatgttattaaaaagattattttttttattaaaggctatttatattatagaaacta

SEQ ID NO: 73315 - DNA, 294 bp, Homo sapiens
gacatgagccactgtgcctgaccagaggttctcaatagtttttaagagtactaaggagtcctgagagcaagaagtttaaacactgccaatttatagtttgaggaagagcaagtttctctgagcatgaccccaaagccagaagagtgacagatacccccaaaatgggaatgaggacatgaaacactaatgggaaaacagcataatacacaaggggccaatatacaggtagaagaataaccttcagaagctgggcacagtggctcatgcctataatcccagcactttgggaagacg

SEQ ID NO: 73316 - DNA, 563 bp, Homo sapiens
ggattccctgaggtcaggagttcgagaccagcctggccaatgtggtgaaaaccctgtctctaataaaaatgtaaaaattagctgggcatggtggcgggcgcctgtagtcccagctactcaggaggctgaggcaggagaattgcttgaaccctggaggcggaggtagcagtgagtcgagatcgcgccactgcactccagcctgggtgacagagcaagactccgtctcgaaaaaaaaaaaaaacagtaagggggaatattggacaatacccccccaaaaatgtgcagaaatagccatatcagacgaaaccgaaattaaggcaaaaccgctgacgggttaagaggaactccgtatcggggggaaaaagacactcccccaagaagatgcagaaaccacactcggcctgttagctttcagtgcatcaaacaaagactcatggtgacaagggggtccatttggggatcccagagcccactggggcctgcaggtcgggctgtccttggccactcctgggacccagagcccgggcatgtccagcaccccctccgccagcccgtgcgccaca

SEQ ID NO: 73317 - DNA, 137 bp, Homo sapiens
ccctgtattcgaaagtgatcgtgggctgcctttgccctggtcattgatagtgcagggagaggaatcaatgaaagcgcttccccgtgtttgaagggtccactcctatcccttccaaactctggagctttcgtacatgc

SEQ ID NO: 73318 - DNA, 4359 bp, Homo sapiens
  misc_feature (3398)..(3398): n is a, c, g, or t
ttctttcttcctttcttttttctctctccccttccttccttctttccttcttttcttttcttttcttttcttttctttctctctttctttctgtctttcttttctcattctgttgccctggctggagtgcagtggcatgatctcggctcatagcagcctccacctcctgggttcaagcgattctcctgccttagcctccctagtagctgggattacaggtacccaccatgatgcctggctaattttttgtattttcaatggagacggggtttcaccatgttggccaggctcgtcttgacctcctggcctcaaatgatccacccactttggcctcccaaattgctggcattacaggcgtgagccactgcacccggcctgttccttcttaagaacactttgtctcccctttaatctctgctggatttcaagcaccccttttacacaactcttgatatccatcaataaagaataattcccataagcccatcatgtagtgaccgactatttttcagtgacaaaaaaaaagtctttaaaaatagaagtaaaagtctaaagtcatcaaaacaacgttatatcctgtgtgaaatgctgcagtcaggatgccttgtggtttgagtgccttgatcatgtgccctaaggggatggtggcggtggtggtggccgtggatgacggagactctcaggccttggcaggtgcgtctttcagttcccctcacacttcgggttcctcggggaggaggggctggaaccctagcccatcgtcaggacaaagatgctcaggctgctcttggctctcaacttattcccttcaattcaagtaacaggaaacaagattttggtgaagcagtcgcccatgcttgtagcgtacgacaatgcggtcaaccttagctgcaagtattcctacaatctcttctcaagggagttccgggcatcccttcacaaaggactggatagtgctgtggaagtctgtgttgtatatgggaattactcccagcagcttcaggtttactcaaaaacggggttcaactgtgatgggaaattgggcaatgaatcagtgacattctacctccagaatttgtatgttaaccaaacagatatttacttctgcaaaattgaagttatgtatcctcctccttacctagacaatgagaagagcaatggaaccattatccatgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctgacacggacgcctatccagaagccagccggctggcagcccccatctgctcaatatcactgctctggataggaaatgaccgccatctccagccggccacctcaggcccctgttgggccaccaatgccaatttttctcgagtgactagaccaaatatcaagatcattttgagactctgaaatgaagtaaaagagatttcctgtgacaggccaagtcttacagtgccatggcccacattccaacttaccatgtacttagtgacttgactgagaagttagggtagaaaacaaaaagggagtggattctgggagcctcttccctttctcactcacctgcacatctcagtcaagcaaagtgtggtatccacagacattttagttgcagaagaaaggctaggaaatcattccttttggttaaatgggtgtttaatcttttggttagtgggttaaacggggtaagttagagtagggggagggataggaagacatatttaaaaaccattaaaacactgtctcccactcatgaaatgagccacgtagttcctatttaatgctgttttcctttagtttagaaatacatagacattgtcttttatgaattctgatcatatttagtcattttgaccaaatgagggatttggtcaaatgagggattccctcaaagcaatatcaggtaaaccaagttgctttcctcactccctgtcatgagacttcagtgttaatgttcacaatatactttcgaaagaataaaatagttctcctacatgaagaaagaatatgtcaggaaataaggtcactttatgtcaaaattatttgagtactatgggacctggcgcagtggctcatgcttgtaatcccagcactttgggaggccgaggtgggcagatcacttgagatcaggaccagcctggtcaagatggtgaaactccgtctgtactaaaaatacaaaatttagcttggcctggtggcaggcacctgtaatcccagctgcccaggaggctgaggcatgagaatcgcttgaacctggcaggcggaggttgcagtgagccgagatagtgccacagctctccagcctgggcgacagagtgagactccatctcaaacaacaacaacaacaacaacaacaacaacaaaccacaaaattatttgagtactgtgaaggattatttgtctaacagttcattccaatcagaccaggtaggagctttcctgtttcatatgtttcagggttgcacagttggtctctttaatgtcggtgtggagatccaaagtgggttgtggaaagagcgtccataggagaagtgagaatactgtgaaaagggatgttagcattcattagagtatgaggatgagtcccaagaaggttctttggaaggaggacgaatagaatggagtaatgaaattcttgccatgtgctgaggagatagccagcattaggtgacaatcttccagaagtggtcaggcagaaggtgccctggtgagagctcctttacagggactttatgtggtttagggctcagagctccaaaactctgggctcagctgctcctgtaccttggaggtccattcacatgggaaagtattttggaatgtgtcttttgaagagagcatcagagttcttaagggactgggtaaggcctgaccctgaaatgaccatggatatttttctacctacagtttgagtcaactagaatatgcctggggaccttgaagaatgcccttcagtggccctcaccatttgttcatgcttcagttaattcaggtgttgaaggagcttaggttttagaggcacgtagacttggttcaagtctcgttagtagttgaatagcctcaggcaagtcactgcccacctaagatgatggttcttcaactataaatggagataatggttacaaatgtctcttcctatagtataatctccataagggcatggcccaagtctgtctttgactctgcctatccctgacntttagtagcatgcccgacatacaatgttagctattggtattattgccatatagataaattatgtataaaaattaaactgggcaatagcctaagaaggggggaatattgtaacacaaatttaaacccactacgcagggatgaggtgctataatatgaggaccttttaacttccatcattttcctgtttcttgaaatagtttatcttgtaatgaaatataaggcacctcccacttttatgtatagaaagaggtcttttaatttttttttaatgtgagaaggaagggaggagtaggaatcttgagattccagatcgaaaatactgtactttggttgatttttaagtgggcttccattccatggatttaatcagtcccaagaagatcaaactcagcagtacttgggtgctgaagaactgttggatttaccctggcacgtgtgccacttgccagcttcttgggcacacagagttcttcaatccaagttatcagattgtatttgaaaatgacagagctggagagttttttgaaatggcagtggcaaataaataaatacttttttttaaatggaaagacttgatctatggtaataaatgattttgttttctgactggaaaaataggcctactaaagatgaatcacacttgagatgtttcttactcactctgcacagaaacaaagaagaaatgttatacagggaagtccgttttcactattagtatgaaccaagaaatggttcaaaaacagtggtaggagcaatgctttcatagtttcagatatggtagttatgaagaaaacaatgtcatttgctgctattattgtaagagtcttataattaatggtactcctataatttttgattgtgagctcacctatttgggttaagcatgccaatttaaagagaccaagtgtatgtacattatgttctacatattcagtgataaaattactaaactactatatgt

SEQ ID NO: 73319 - DNA, 4068 bp, Homo sapiens
  misc_feature (3107)..(3107): n is a, c, g, or t
ttctttcttcctttcttttttctctctccccttccttccttctttccttcttttcttttcttttcttttcttttctttctctctttctttctgtctttcttttctcattctgttgccctggctggagtgcagtggcatgatctcggctcatagcagcctccacctcctgggttcaagcgattctcctgccttagcctccctagtagctgggattacaggtacccaccatgatgcctggctaattttttgtattttcaatggagacggggtttcaccatgttggccaggctcgtcttgacctcctggcctcaaatgatccacccactttggcctcccaaattgctggcattacaggcgtgagccactgcacccggcctgttccttcttaagaacactttgtctcccctttaatctctgctggatttcaagcaccccttttacacaactcttgatatccatcaataaagaataattcccataagcccatcatgtagtgaccgactatttttcagtgacaaaaaaaaagtctttaaaaatagaagtaaaagtctaaagtcatcaaaacaacgttatatcctgtgtgaaatgctgcagtcaggatgccttgtggtttgagtgccttgatcatgtgccctaaggggatggtggcggtggtggtggccgtggatgacggagactctcaggccttggcaggtgcgtctttcagttcccctcacacttcgggttcctcggggaggaggggctggaaccctagcccatcgtcaggacaaagatgctcaggctgctcttggctctcaacttattcccttcaattcaagtaacaggaaacaagattttggtgaagcagtcgcccatgcttgtagcgtacgacaatgcggtcaaccttagctggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctgacacggacgcctatccagaagccagccggctggcagcccccatctgctcaatatcactgctctggataggaaatgaccgccatctccagccggccacctcaggcccctgttgggccaccaatgccaatttttctcgagtgactagaccaaatatcaagatcattttgagactctgaaatgaagtaaaagagatttcctgtgacaggccaagtcttacagtgccatggcccacattccaacttaccatgtacttagtgacttgactgagaagttagggtagaaaacaaaaagggagtggattctgggagcctcttccctttctcactcacctgcacatctcagtcaagcaaagtgtggtatccacagacattttagttgcagaagaaaggctaggaaatcattccttttggttaaatgggtgtttaatcttttggttagtgggttaaacggggtaagttagagtagggggagggataggaagacatatttaaaaaccattaaaacactgtctcccactcatgaaatgagccacgtagttcctatttaatgctgttttcctttagtttagaaatacatagacattgtcttttatgaattctgatcatatttagtcattttgaccaaatgagggatttggtcaaatgagggattccctcaaagcaatatcaggtaaaccaagttgctttcctcactccctgtcatgagacttcagtgttaatgttcacaatatactttcgaaagaataaaatagttctcctacatgaagaaagaatatgtcaggaaataaggtcactttatgtcaaaattatttgagtactatgggacctggcgcagtggctcatgcttgtaatcccagcactttgggaggccgaggtgggcagatcacttgagatcaggaccagcctggtcaagatggtgaaactccgtctgtactaaaaatacaaaatttagcttggcctggtggcaggcacctgtaatcccagctgcccaggaggctgaggcatgagaatcgcttgaacctggcaggcggaggttgcagtgagccgagatagtgccacagctctccagcctgggcgacagagtgagactccatctcaaacaacaacaacaacaacaacaacaacaacaaaccacaaaattatttgagtactgtgaaggattatttgtctaacagttcattccaatcagaccaggtaggagctttcctgtttcatatgtttcagggttgcacagttggtctctttaatgtcggtgtggagatccaaagtgggttgtggaaagagcgtccataggagaagtgagaatactgtgaaaagggatgttagcattcattagagtatgaggatgagtcccaagaaggttctttggaaggaggacgaatagaatggagtaatgaaattcttgccatgtgctgaggagatagccagcattaggtgacaatcttccagaagtggtcaggcagaaggtgccctggtgagagctcctttacagggactttatgtggtttagggctcagagctccaaaactctgggctcagctgctcctgtaccttggaggtccattcacatgggaaagtattttggaatgtgtcttttgaagagagcatcagagttcttaagggactgggtaaggcctgaccctgaaatgaccatggatatttttctacctacagtttgagtcaactagaatatgcctggggaccttgaagaatgcccttcagtggccctcaccatttgttcatgcttcagttaattcaggtgttgaaggagcttaggttttagaggcacgtagacttggttcaagtctcgttagtagttgaatagcctcaggcaagtcactgcccacctaagatgatggttcttcaactataaatggagataatggttacaaatgtctcttcctatagtataatctccataagggcatggcccaagtctgtctttgactctgcctatccctgacntttagtagcatgcccgacatacaatgttagctattggtattattgccatatagataaattatgtataaaaattaaactgggcaatagcctaagaaggggggaatattgtaacacaaatttaaacccactacgcagggatgaggtgctataatatgaggaccttttaacttccatcattttcctgtttcttgaaatagtttatcttgtaatgaaatataaggcacctcccacttttatgtatagaaagaggtcttttaatttttttttaatgtgagaaggaagggaggagtaggaatcttgagattccagatcgaaaatactgtactttggttgatttttaagtgggcttccattccatggatttaatcagtcccaagaagatcaaactcagcagtacttgggtgctgaagaactgttggatttaccctggcacgtgtgccacttgccagcttcttgggcacacagagttcttcaatccaagttatcagattgtatttgaaaatgacagagctggagagttttttgaaatggcagtggcaaataaataaatacttttttttaaatggaaagacttgatctatggtaataaatgattttgttttctgactggaaaaataggcctactaaagatgaatcacacttgagatgtttcttactcactctgcacagaaacaaagaagaaatgttatacagggaagtccgttttcactattagtatgaaccaagaaatggttcaaaaacagtggtaggagcaatgctttcatagtttcagatatggtagttatgaagaaaacaatgtcatttgctgctattattgtaagagtcttataattaatggtactcctataatttttgattgtgagctcacctatttgggttaagcatgccaatttaaagagaccaagtgtatgtacattatgttctacatattcagtgataaaattactaaactactatatgt

SEQ ID NO: 73320 - DNA, 4002 bp, Homo sapiens
  misc_feature (3041)..(3041): n is a, c, g, or t
ttctttcttcctttcttttttctctctccccttccttccttctttccttcttttcttttcttttcttttcttttctttctctctttctttctgtctttcttttctcattctgttgccctggctggagtgcagtggcatgatctcggctcatagcagcctccacctcctgggttcaagcgattctcctgccttagcctccctagtagctgggattacaggtacccaccatgatgcctggctaattttttgtattttcaatggagacggggtttcaccatgttggccaggctcgtcttgacctcctggcctcaaatgatccacccactttggcctcccaaattgctggcattacaggcgtgagccactgcacccggcctgttccttcttaagaacactttgtctcccctttaatctctgctggatttcaagcaccccttttacacaactcttgatatccatcaataaagaataattcccataagcccatcatgtagtgaccgactatttttcagtgacaaaaaaaaagtctttaaaaatagaagtaaaagtctaaagtcatcaaaacaacgttatatcctgtgtgaaatgctgcagtcaggatgccttgtggtttgagtgccttgatcatgtgccctaaggggatggtggcggtggtggtggccgtggatgacggagactctcaggccttggcaggtgcgtctttcagttcccctcacacttcgggttcctcggggaggaggggctggaaccctagcccatcgtcaggacaaagatgctcaggctgctcttggctctcaacttattcccttcaattcaagtaacagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctgacacggacgcctatccagaagccagccggctggcagcccccatctgctcaatatcactgctctggataggaaatgaccgccatctccagccggccacctcaggcccctgttgggccaccaatgccaatttttctcgagtgactagaccaaatatcaagatcattttgagactctgaaatgaagtaaaagagatttcctgtgacaggccaagtcttacagtgccatggcccacattccaacttaccatgtacttagtgacttgactgagaagttagggtagaaaacaaaaagggagtggattctgggagcctcttccctttctcactcacctgcacatctcagtcaagcaaagtgtggtatccacagacattttagttgcagaagaaaggctaggaaatcattccttttggttaaatgggtgtttaatcttttggttagtgggttaaacggggtaagttagagtagggggagggataggaagacatatttaaaaaccattaaaacactgtctcccactcatgaaatgagccacgtagttcctatttaatgctgttttcctttagtttagaaatacatagacattgtcttttatgaattctgatcatatttagtcattttgaccaaatgagggatttggtcaaatgagggattccctcaaagcaatatcaggtaaaccaagttgctttcctcactccctgtcatgagacttcagtgttaatgttcacaatatactttcgaaagaataaaatagttctcctacatgaagaaagaatatgtcaggaaataaggtcactttatgtcaaaattatttgagtactatgggacctggcgcagtggctcatgcttgtaatcccagcactttgggaggccgaggtgggcagatcacttgagatcaggaccagcctggtcaagatggtgaaactccgtctgtactaaaaatacaaaatttagcttggcctggtggcaggcacctgtaatcccagctgcccaggaggctgaggcatgagaatcgcttgaacctggcaggcggaggttgcagtgagccgagatagtgccacagctctccagcctgggcgacagagtgagactccatctcaaacaacaacaacaacaacaacaacaacaacaaaccacaaaattatttgagtactgtgaaggattatttgtctaacagttcattccaatcagaccaggtaggagctttcctgtttcatatgtttcagggttgcacagttggtctctttaatgtcggtgtggagatccaaagtgggttgtggaaagagcgtccataggagaagtgagaatactgtgaaaagggatgttagcattcattagagtatgaggatgagtcccaagaaggttctttggaaggaggacgaatagaatggagtaatgaaattcttgccatgtgctgaggagatagccagcattaggtgacaatcttccagaagtggtcaggcagaaggtgccctggtgagagctcctttacagggactttatgtggtttagggctcagagctccaaaactctgggctcagctgctcctgtaccttggaggtccattcacatgggaaagtattttggaatgtgtcttttgaagagagcatcagagttcttaagggactgggtaaggcctgaccctgaaatgaccatggatatttttctacctacagtttgagtcaactagaatatgcctggggaccttgaagaatgcccttcagtggccctcaccatttgttcatgcttcagttaattcaggtgttgaaggagcttaggttttagaggcacgtagacttggttcaagtctcgttagtagttgaatagcctcaggcaagtcactgcccacctaagatgatggttcttcaactataaatggagataatggttacaaatgtctcttcctatagtataatctccataagggcatggcccaagtctgtctttgactctgcctatccctgacntttagtagcatgcccgacatacaatgttagctattggtattattgccatatagataaattatgtataaaaattaaactgggcaatagcctaagaaggggggaatattgtaacacaaatttaaacccactacgcagggatgaggtgctataatatgaggaccttttaacttccatcattttcctgtttcttgaaatagtttatcttgtaatgaaatataaggcacctcccacttttatgtatagaaagaggtcttttaatttttttttaatgtgagaaggaagggaggagtaggaatcttgagattccagatcgaaaatactgtactttggttgatttttaagtgggcttccattccatggatttaatcagtcccaagaagatcaaactcagcagtacttgggtgctgaagaactgttggatttaccctggcacgtgtgccacttgccagcttcttgggcacacagagttcttcaatccaagttatcagattgtatttgaaaatgacagagctggagagttttttgaaatggcagtggcaaataaataaatacttttttttaaatggaaagacttgatctatggtaataaatgattttgttttctgactggaaaaataggcctactaaagatgaatcacacttgagatgtttcttactcactctgcacagaaacaaagaagaaatgttatacagggaagtccgttttcactattagtatgaaccaagaaatggttcaaaaacagtggtaggagcaatgctttcatagtttcagatatggtagttatgaagaaaacaatgtcatttgctgctattattgtaagagtcttataattaatggtactcctataatttttgattgtgagctcacctatttgggttaagcatgccaatttaaagagaccaagtgtatgtacattatgttctacatattcagtgataaaattactaaactactatatgt

SEQ ID NO: 73321 - DNA, 3940 bp, Homo sapiens
  misc_feature (2979)..(2979): n is a, c, g, or t
ttctttcttcctttcttttttctctctccccttccttccttctttccttcttttcttttcttttcttttcttttctttctctctttctttctgtctttcttttctcattctgttgccctggctggagtgcagtggcatgatctcggctcatagcagcctccacctcctgggttcaagcgattctcctgccttagcctccctagtagctgggattacaggtacccaccatgatgcctggctaattttttgtattttcaatggagacggggtttcaccatgttggccaggctcgtcttgacctcctggcctcaaatgatccacccactttggcctcccaaattgctggcattacaggcgtgagccactgcacccggcctgttccttcttaagaacactttgtctcccctttaatctctgctggatttcaagcaccccttttacacaactcttgatatccatcaataaagaataattcccataagcccatcatgtagtgaccgactatttttcagtgacaaaaaaaaagtctttaaaaatagaagtaaaagtctaaagtcatcaaaacaacgttatatcctgtgtgaaatgctgcagtcaggatgccttgtggtttgagtgccttgatcatgtgccctaaggggatggtggcggtggtggtggccgtggatgacggagactctcaggccttggcaggtgcgtctttcagttcccctcacacttcgggttcctcggggaggaggggctggaaccctagcccatcgtcaggacaaagatgctcaggctgctcttggctctcaacttattcccttcaattcaagtaacaggaaacaagattttggtgaagcagtcgcccatgcttgtagcgtacgacaatgcggtcaaccttagctacaatgagaagagcaatggaaccattatccatgtgaaagggaaacacctttgtccaagtcccctatttcccggaccttctaagcccctatgccccaccacgcgacttcgcagcctatcgctcctgacacggacgcctatccagaagccagccggctggcagcccccatctgctcaatatcactgctctggataggaaatgaccgccatctccagccggccacctcaggcccctgttgggccaccaatgccaatttttctcgagtgactagaccaaatatcaagatcattttgagactctgaaatgaagtaaaagagatttcctgtgacaggccaagtcttacagtgccatggcccacattccaacttaccatgtacttagtgacttgactgagaagttagggtagaaaacaaaaagggagtggattctgggagcctcttccctttctcactcacctgcacatctcagtcaagcaaagtgtggtatccacagacattttagttgcagaagaaaggctaggaaatcattccttttggttaaatgggtgtttaatcttttggttagtgggttaaacggggtaagttagagtagggggagggataggaagacatatttaaaaaccattaaaacactgtctcccactcatgaaatgagccacgtagttcctatttaatgctgttttcctttagtttagaaatacatagacattgtcttttatgaattctgatcatatttagtcattttgaccaaatgagggatttggtcaaatgagggattccctcaaagcaatatcaggtaaaccaagttgctttcctcactccctgtcatgagacttcagtgttaatgttcacaatatactttcgaaagaataaaatagttctcctacatgaagaaagaatatgtcaggaaataaggtcactttatgtcaaaattatttgagtactatgggacctggcgcagtggctcatgcttgtaatcccagcactttgggaggccgaggtgggcagatcacttgagatcaggaccagcctggtcaagatggtgaaactccgtctgtactaaaaatacaaaatttagcttggcctggtggcaggcacctgtaatcccagctgcccaggaggctgaggcatgagaatcgcttgaacctggcaggcggaggttgcagtgagccgagatagtgccacagctctccagcctgggcgacagagtgagactccatctcaaacaacaacaacaacaacaacaacaacaacaaaccacaaaattatttgagtactgtgaaggattatttgtctaacagttcattccaatcagaccaggtaggagctttcctgtttcatatgtttcagggttgcacagttggtctctttaatgtcggtgtggagatccaaagtgggttgtggaaagagcgtccataggagaagtgagaatactgtgaaaagggatgttagcattcattagagtatgaggatgagtcccaagaaggttctttggaaggaggacgaatagaatggagtaatgaaattcttgccatgtgctgaggagatagccagcattaggtgacaatcttccagaagtggtcaggcagaaggtgccctggtgagagctcctttacagggactttatgtggtttagggctcagagctccaaaactctgggctcagctgctcctgtaccttggaggtccattcacatgggaaagtattttggaatgtgtcttttgaagagagcatcagagttcttaagggactgggtaaggcctgaccctgaaatgaccatggatatttttctacctacagtttgagtcaactagaatatgcctggggaccttgaagaatgcccttcagtggccctcaccatttgttcatgcttcagttaattcaggtgttgaaggagcttaggttttagaggcacgtagacttggttcaagtctcgttagtagttgaatagcctcaggcaagtcactgcccacctaagatgatggttcttcaactataaatggagataatggttacaaatgtctcttcctatagtataatctccataagggcatggcccaagtctgtctttgactctgcctatccctgacntttagtagcatgcccgacatacaatgttagctattggtattattgccatatagataaattatgtataaaaattaaactgggcaatagcctaagaaggggggaatattgtaacacaaatttaaacccactacgcagggatgaggtgctataatatgaggaccttttaacttccatcattttcctgtttcttgaaatagtttatcttgtaatgaaatataaggcacctcccacttttatgtatagaaagaggtcttttaatttttttttaatgtgagaaggaagggaggagtaggaatcttgagattccagatcgaaaatactgtactttggttgatttttaagtgggcttccattccatggatttaatcagtcccaagaagatcaaactcagcagtacttgggtgctgaagaactgttggatttaccctggcacgtgtgccacttgccagcttcttgggcacacagagttcttcaatccaagttatcagattgtatttgaaaatgacagagctggagagttttttgaaatggcagtggcaaataaataaatacttttttttaaatggaaagacttgatctatggtaataaatgattttgttttctgactggaaaaataggcctactaaagatgaatcacacttgagatgtttcttactcactctgcacagaaacaaagaagaaatgttatacagggaagtccgttttcactattagtatgaaccaagaaatggttcaaaaacagtggtaggagcaatgctttcatagtttcagatatggtagttatgaagaaaacaatgtcatttgctgctattattgtaagagtcttataattaatggtactcctataatttttgattgtgagctcacctatttgggttaagcatgccaatttaaagagaccaagtgtatgtacattatgttctacatattcagtgataaaattactaaactactatatgt

SEQ ID NO: 73322 - DNA, 3982 bp, Homo sapiens
  misc_feature (3021)..(3021): n is a, c, g, or t
ttctttcttcctttcttttttctctctccccttccttccttctttccttcttttcttttcttttcttttcttttctttctctctttctttctgtctttcttttctcattctgttgccctggctggagtgcagtggcatgatctcggctcatagcagcctccacctcctgggttcaagcgattctcctgccttagcctccctagtagctgggattacaggtacccaccatgatgcctggctaattttttgtattttcaatggagacggggtttcaccatgttggccaggctcgtcttgacctcctggcctcaaatgatccacccactttggcctcccaaattgctggcattacaggcgtgagccactgcacccggcctgttccttcttaagaacactttgtctcccctttaatctctgctggatttcaagcaccccttttacacaactcttgatatccatcaataaagaataattcccataagcccatcatgtagtgaccgactatttttcagtgacaaaaaaaaagtctttaaaaatagaagtaaaagtctaaagtcatcaaaacaacgttatatcctgtgtgaaatgctgcagtcaggatgccttgtggtttgagtgccttgatcatgtgccctaaggggatggtggcggtggtggtggccgtggatgacggagactctcaggccttggcaggtgcgtctttcagttcccctcacacttcgggttcctcggggaggaggggctggaaccctagcccatcgtcaggacaaagatgctcaggctgctcttggctctcaacttattcccttcaattcaagtaacaggaaacaagattttggtgaagcagtcgcccatgcttgtagcgtacgacaatgcggtcaaccttagctacaatgagaagagcaatggaaccattatccatgtgaaaggtgaggagtaagaggagcaggctcctgcacagtgactacatgaacatgactccccgccgccccgggcccacccgcaagcattaccagccctatgccccaccacgcgacttcgcagcctatcgctcctgacacggacgcctatccagaagccagccggctggcagcccccatctgctcaatatcactgctctggataggaaatgaccgccatctccagccggccacctcaggcccctgttgggccaccaatgccaatttttctcgagtgactagaccaaatatcaagatcattttgagactctgaaatgaagtaaaagagatttcctgtgacaggccaagtcttacagtgccatggcccacattccaacttaccatgtacttagtgacttgactgagaagttagggtagaaaacaaaaagggagtggattctgggagcctcttccctttctcactcacctgcacatctcagtcaagcaaagtgtggtatccacagacattttagttgcagaagaaaggctaggaaatcattccttttggttaaatgggtgtttaatcttttggttagtgggttaaacggggtaagttagagtagggggagggataggaagacatatttaaaaaccattaaaacactgtctcccactcatgaaatgagccacgtagttcctatttaatgctgttttcctttagtttagaaatacatagacattgtcttttatgaattctgatcatatttagtcattttgaccaaatgagggatttggtcaaatgagggattccctcaaagcaatatcaggtaaaccaagttgctttcctcactccctgtcatgagacttcagtgttaatgttcacaatatactttcgaaagaataaaatagttctcctacatgaagaaagaatatgtcaggaaataaggtcactttatgtcaaaattatttgagtactatgggacctggcgcagtggctcatgcttgtaatcccagcactttgggaggccgaggtgggcagatcacttgagatcaggaccagcctggtcaagatggtgaaactccgtctgtactaaaaatacaaaatttagcttggcctggtggcaggcacctgtaatcccagctgcccaggaggctgaggcatgagaatcgcttgaacctggcaggcggaggttgcagtgagccgagatagtgccacagctctccagcctgggcgacagagtgagactccatctcaaacaacaacaacaacaacaacaacaacaacaaaccacaaaattatttgagtactgtgaaggattatttgtctaacagttcattccaatcagaccaggtaggagctttcctgtttcatatgtttcagggttgcacagttggtctctttaatgtcggtgtggagatccaaagtgggttgtggaaagagcgtccataggagaagtgagaatactgtgaaaagggatgttagcattcattagagtatgaggatgagtcccaagaaggttctttggaaggaggacgaatagaatggagtaatgaaattcttgccatgtgctgaggagatagccagcattaggtgacaatcttccagaagtggtcaggcagaaggtgccctggtgagagctcctttacagggactttatgtggtttagggctcagagctccaaaactctgggctcagctgctcctgtaccttggaggtccattcacatgggaaagtattttggaatgtgtcttttgaagagagcatcagagttcttaagggactgggtaaggcctgaccctgaaatgaccatggatatttttctacctacagtttgagtcaactagaatatgcctggggaccttgaagaatgcccttcagtggccctcaccatttgttcatgcttcagttaattcaggtgttgaaggagcttaggttttagaggcacgtagacttggttcaagtctcgttagtagttgaatagcctcaggcaagtcactgcccacctaagatgatggttcttcaactataaatggagataatggttacaaatgtctcttcctatagtataatctccataagggcatggcccaagtctgtctttgactctgcctatccctgacntttagtagcatgcccgacatacaatgttagctattggtattattgccatatagataaattatgtataaaaattaaactgggcaatagcctaagaaggggggaatattgtaacacaaatttaaacccactacgcagggatgaggtgctataatatgaggaccttttaacttccatcattttcctgtttcttgaaatagtttatcttgtaatgaaatataaggcacctcccacttttatgtatagaaagaggtcttttaatttttttttaatgtgagaaggaagggaggagtaggaatcttgagattccagatcgaaaatactgtactttggttgatttttaagtgggcttccattccatggatttaatcagtcccaagaagatcaaactcagcagtacttgggtgctgaagaactgttggatttaccctggcacgtgtgccacttgccagcttcttgggcacacagagttcttcaatccaagttatcagattgtatttgaaaatgacagagctggagagttttttgaaatggcagtggcaaataaataaatacttttttttaaatggaaagacttgatctatggtaataaatgattttgttttctgactggaaaaataggcctactaaagatgaatcacacttgagatgtttcttactcactctgcacagaaacaaagaagaaatgttatacagggaagtccgttttcactattagtatgaaccaagaaatggttcaaaaacagtggtaggagcaatgctttcatagtttcagatatggtagttatgaagaaaacaatgtcatttgctgctattattgtaagagtcttataattaatggtactcctataatttttgattgtgagctcacctatttgggttaagcatgccaatttaaagagaccaagtgtatgtacattatgttctacatattcagtgataaaattactaaactactatatgt

SEQ ID NO: 73323 - DNA, 335 bp, Homo sapiens
gtcagcctggttaccaaggagaaccaggtcttcgtggctggaggcctcttctacaacgaagacaacaaagaggaccccatgagcgcatacttcctgcagtttgaccatctggactcagagtggctggggatgccaccgctgccctcgccccgctgcctctttggcctgggagaagctctcaactccatctacgtggtcggtggcagagagatcaaggacggcgagcgctgcctggactcggtcatgtgctacgacaggctgtcattcaaatggggtgaatcggacccgctgccttacgtggtgtatggccacacagtgctctcccacatggacct

SEQ ID NO: 73324 - DNA, 83 bp, Homo sapiens
gtgctttgctgagggtgctcatctaagagccagggaaatcccagtcaacagaacacaggacggcatgcagggtgatacgtgat

SEQ ID NO: 73325 - DNA, 3108 bp, Homo sapiens
ctggaggcgccggcagcgcccgccagacccgccagcccagcggcccgggctctggggaaaccggcgctcccgacaggggagcaccgggcctctgagctccctcgggagcctttcacgaggtcagctacgtctttgttgtgcgcgttcctgaacttttggtccattaaccaacaattagacacgccggtattcagtgcctggcgcggtgctagatgctgggtgtaatctcagaaaaatacattcaggggcgcgcctgagggtgctggctgctggcatctcaggtgctttacgtgcattcgtgaagaagcccatcagtatttcttgaataccagatctctatttctgaatatagaccccaagctaagtgaagctttagcctctaagctcaacatgtatgaagctttgccaggccctgctcctgaaaatgaagatggccttgtgaaagtgaaggaggaagatcccacctgggagcaggtgtgcaactcacaggagggcagctcccacactcaggagatttgccgcctgcgctttcggcacttctgctaccaggaggctcacggaccccaggaagctctggcccaactccgagaactttgtcatcaatggctgagaccggagatgcacaccaaggaacagataatggaactgctggtgctggagcagttcctgaccatcctgcccaaggagctccagccctgtgtgaagacatatcctctggagagtggagaggaggcagtgacagtgctggagaatctagagacaggaagtggagacacaggacaacaggcctctgtctatattcagggacaggacatgcacccaatggtggcagaatatcaaggagtctctttggagtgtcagagcctccagctcctgcctgggataaccaccctgaagtgtgaacctccacagcgtcctcaagggaacccccaagaagtgagtgggcctgttccccacggatcagctcatctccaggaaaaaaaccccagagacaaggctgtagtgcctgtgtttaacccagtcaggtcccagacattggtgaagactgaggaagaaacagcccaggccgttgctgcagagaagtggtcacatctgagtctgactcggaggaacctctgtgggaactcagctcaggagacagttatgagcctcagtccgatgactgaagaaattgtaactaaagatagattgtttaaagcaaagcaagaaacttctgaagaaatggaacaaagtggagaagcctcaggaaagcccaacagagagtgtgcaccccagattccttgtagtactcctattgctactgaaaggacagttgcacatttgaacactctgaaggaccgtcacccaggtgatttgtgggcccgcatgcacatctcatccctggaatatgctgcaggagacattacccgaaaagggagaaaaaaagacaaagctcgagtgagtgaactgctccaaggcctctcattctctggtgactcagatgtggaaaaagataatgagcctgagatccagcctgctcaaaagaagttaaaggtatcatgtttcccagaaaagagttggaccaaaagagacattaaacccaattttccaagctggtcagcactggattctggacttttgaatctcaagagcgaaaagttgaacccagtagagctttttgaattattttttgatgatgaaacattcaacttaattgtcaatgaaaccaataattatgcttctcagaaaaatgtcagcttggaagtcacagttcaggaaatgaggtgtgtgtttggtgtcttacttttgagtggatttatgaggcatcctagaagggaaatgtattgggaagtctctgacaccgatcagaacctggttagagatgcaatcagaagggacagatttgaattgattttctcaaacctgcactttgcagataatggccacctagatcaaaaagataagtttacaaagttgagacctctcataaaacaaatgaataaaaatttcctcttgtatgctcccctggaagaatactattgctttgataagtcaatgtgtgaatgctttgatagtgaccaattcctgaatggaaagcctattagaattggctataaaatttggtgtggtacaaccacacagggttatctggtttggtttgaaccctatcaagaagaatcaactatgaaggtagatgaggatcctgatcttgggttaggtggaaatctagtgatgaacttcgctgatgttcttttagagagaggtcagtatccctatcacctgtgttttgatagcttctttacaagtgtcaaattgttgtcagccttgaaaaagaagggggtgagggcaacaggaacaattcgtgagaacaggaccgaaaaatgtccccttatgaatgtagaacatatgaaaaaaatgaagagagggtattttgatttccgaatagaagaaaacaatgagataattttgtgtcgttggtatggggatggcattatcagtctgtgctccaatgctgtgggcatagaaccagtcaatgaggtaagctgttgtgatgctgataacgaagaaatccctcagataagtcaaccatccatagtaaaagtgtatgatgaatgcaaggaaggtgtagctaaaatggatcaaattatttcgaaatacagggtgaggataagaagcaagaaatggtactcaattttggtgagctacatgattgatgtagccatgaacaatgcatggcaactacacagagcctgtaacccaggtgcttctctagaccccttggattttcggagatttgttgcacatttctacttggaacacaatgctcatctgtcagattagggtacataaaatggacatagtgcagacattaataagacatagaaaaataataattatacatgctgttgtaccctcccaaagtaaatctgatatatgtaatgaagttattaaataatacttttaaaaatcagacatttatatagagtttcaaagactattgtaacaagtaatgttaaaaattgtctgtgagaatgttgaactgtagtacctttctctatgtcaagttttgtgtcagacatgggaaatcatgtatttgttcaattgactactttgtgcacttatttattt

SEQ ID NO: 73326 - DNA, 3088 bp, Homo sapiens
ctggaggcgccggcagcgcccgccagacccgccagcccagcggcccgggctctggggaaaccggcgctcccgacaggggagcaccgggcctctgagctccctcgggagcctttcacgaggtcagctacgtctttgttgtgcgcgttcctgaacttttggtccattaaccaacaattagacacgccggtattcagtgcctggcgcggtgctagatgctgggtgtaatctcagaaaaatacattcaggggcgcgcctgagggtgctggctgctggcatctcaggtgctttacgtgcattcgtgaagaagcccatcagtatttcttgaataccagaccccaagctaagtgaagctttagcctctaagctcaacatgtatgaagctttgccaggccctgctcctgaaaatgaagatggccttgtgaaagtgaaggaggaagatcccacctgggagcaggtgtgcaactcacaggagggcagctcccacactcaggagatttgccgcctgcgctttcggcacttctgctaccaggaggctcacggaccccaggaagctctggcccaactccgagaactttgtcatcaatggctgagaccggagatgcacaccaaggaacagataatggaactgctggtgctggagcagttcctgaccatcctgcccaaggagctccagccctgtgtgaagacatatcctctggagagtggagaggaggcagtgacagtgctggagaatctagagacaggaagtggagacacaggacaacaggcctctgtctatattcagggacaggacatgcacccaatggtggcagaatatcaaggagtctctttggagtgtcagagcctccagctcctgcctgggataaccaccctgaagtgtgaacctccacagcgtcctcaagggaacccccaagaagtgagtgggcctgttccccacggatcagctcatctccaggaaaaaaaccccagagacaaggctgtagtgcctgtgtttaacccagtcaggtcccagacattggtgaagactgaggaagaaacagcccaggccgttgctgcagagaagtggtcacatctgagtctgactcggaggaacctctgtgggaactcagctcaggagacagttatgagcctcagtccgatgactgaagaaattgtaactaaagatagattgtttaaagcaaagcaagaaacttctgaagaaatggaacaaagtggagaagcctcaggaaagcccaacagagagtgtgcaccccagattccttgtagtactcctattgctactgaaaggacagttgcacatttgaacactctgaaggaccgtcacccaggtgatttgtgggcccgcatgcacatctcatccctggaatatgctgcaggagacattacccgaaaagggagaaaaaaagacaaagctcgagtgagtgaactgctccaaggcctctcattctctggtgactcagatgtggaaaaagataatgagcctgagatccagcctgctcaaaagaagttaaaggtatcatgtttcccagaaaagagttggaccaaaagagacattaaacccaattttccaagctggtcagcactggattctggacttttgaatctcaagagcgaaaagttgaacccagtagagctttttgaattattttttgatgatgaaacattcaacttaattgtcaatgaaaccaataattatgcttctcagaaaaatgtcagcttggaagtcacagttcaggaaatgaggtgtgtgtttggtgtcttacttttgagtggatttatgaggcatcctagaagggaaatgtattgggaagtctctgacaccgatcagaacctggttagagatgcaatcagaagggacagatttgaattgattttctcaaacctgcactttgcagataatggccacctagatcaaaaagataagtttacaaagttgagacctctcataaaacaaatgaataaaaatttcctcttgtatgctcccctggaagaatactattgctttgataagtcaatgtgtgaatgctttgatagtgaccaattcctgaatggaaagcctattagaattggctataaaatttggtgtggtacaaccacacagggttatctggtttggtttgaaccctatcaagaagaatcaactatgaaggtagatgaggatcctgatcttgggttaggtggaaatctagtgatgaacttcgctgatgttcttttagagagaggtcagtatccctatcacctgtgttttgatagcttctttacaagtgtcaaattgttgtcagccttgaaaaagaagggggtgagggcaacaggaacaattcgtgagaacaggaccgaaaaatgtccccttatgaatgtagaacatatgaaaaaaatgaagagagggtattttgatttccgaatagaagaaaacaatgagataattttgtgtcgttggtatggggatggcattatcagtctgtgctccaatgctgtgggcatagaaccagtcaatgaggtaagctgttgtgatgctgataacgaagaaatccctcagataagtcaaccatccatagtaaaagtgtatgatgaatgcaaggaaggtgtagctaaaatggatcaaattatttcgaaatacagggtgaggataagaagcaagaaatggtactcaattttggtgagctacatgattgatgtagccatgaacaatgcatggcaactacacagagcctgtaacccaggtgcttctctagaccccttggattttcggagatttgttgcacatttctacttggaacacaatgctcatctgtcagattagggtacataaaatggacatagtgcagacattaataagacatagaaaaataataattatacatgctgttgtaccctcccaaagtaaatctgatatatgtaatgaagttattaaataatacttttaaaaatcagacatttatatagagtttcaaagactattgtaacaagtaatgttaaaaattgtctgtgagaatgttgaactgtagtacctttctctatgtcaagttttgtgtcagacatgggaaatcatgtatttgttcaattgactactttgtgcacttatttattt

SEQ ID NO: 73327 - DNA, 1573 bp, Homo sapiens
ctggaggcgccggcagcgcccgccagacccgccagcccagcggcccgggctctggggaaaccggcgctcccgacaggggagcaccgggcctctgagctccctcgggagcctttcacgaggtcagctacgtctttgttgtgcgcgttcctgaacttttggtccattaaccaacaattagacacgccggtattcagtgcctggcgcggtgctagatgctgggtgtaatctcagaaaaatacattcaggggcgcgcctgagggtgctggctgctggcatctcaggtgctttacgtgcattcgtgaagaagcccatcagtatttcttgaataccagatctctatttctgaatatagaccccaagctaagtgaagctttagcctctaagctcaacatgtatgaagctttgccaggccctgctcctgaaaatgaagatggccttgtgaaagtgaaggaggaagatcccacctgggagcaggtgtgcaactcacaggagggcagctcccacactcaggagatttgccgcctgcgctttcggcacttctgctaccaggaggctcacggaccccaggaagctctggcccaactccgagaactttgtcatcaatggctgagaccggagatgcacaccaaggaacagataatggaactgctggtgctggagcagttcctgaccatcctgcccaaggagctccagccctgtgtgaagacatatcctctggagagtggagaggaggcagtgacagtgctggagaatctagagacaggaagtggagacacaggacaacaggcctctgtctatattcagggacaggacatgcacccaatggtggcagaatatcaaggagtctctttggagtgtcagagcctccagctcctgcctgggataaccaccctgaagtgtgaacctccacagcgtcctcaagggaacccccaagaagtgagtgggcctgttccccacggatcagctcatctccaggaaaaaaaccccagagacaaggctgtagtgcctgtgtttaacccagtcaggtcccagacattggtgaagactgaggaagaaacagcccaggccgttgctgcagagaagtggtcacatctgagtctgactcggaggaacctctgtgggaactcagctcaggagacagttatgagcctcagtccgatgagtaaggccaggcctctggctggacccctgtctggactctcattttcctgtcactcaccctggcttggcccttgggaggccacgtttcctacagacccacacccttcctttcccttcttctggcctctgcctccagacttctagcccttatcactttgcatccttcccaatcacattttcttctgttactaatcagtttactgattgttgtggttatcttctctgatcatctcttctagttccctgattccttcagtgactcctttgtatccttttccccttttttcttccctgtcaaggattccatataacttgtctttcagatatcccttcatacttggaagccccatgaacacctctgtctgaccttgtctttacctcagaggaggtcatcttcactctctaagaacac

SEQ ID NO: 73328 - DNA, 402 bp, Homo sapiens
cactttgtaaggtttttacttaatatcagagtagttctattttctcatattattttaaaacatttttcatagctgtatagaatttattgtatgggtcagccataatttgtttaatcagtcccataacatagggtctcagtatatgtattggttttctaccagctgctgcaaattacctcaaatttaattgatatgtaataactgtacatatttatggagtacaacgtgatgtttcaatacatgacagttatgtatcaattaaaaataaaagaaaaccttaaaaatgaaaaaaatcccacaaattatcttacagtctagtatgtcagaaatctgacagaggtcagatagatttacttctgcctccgtcttctactattaagactctcatgcttatattaggcc

SEQ ID NO: 73329 - DNA, 459 bp, Homo sapiens
ccctccccgcgcgcgtgcgcgccgcggccgcgcctgcgcagtgtagccgggtcagctggacagggtcatcctgagggtgcgactccgccgcgatggtgacccggttcctgggcccacgctaccgggagctggtcaagaactgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtgcctggtggtgctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctgc

SEQ ID NO: 73330 - DNA, 480 bp, Homo sapiens
  misc_feature (16)..(16): n is a, c, g, or t
  misc_feature (33)..(33): n is a, c, g, or t
  misc_feature (83)..(83): n is a, c, g, or t
ctggacttaaagcttnaaattgcttttaagtgnccccaaaacttccctctctctctctctctctctctcctacttcttccttnccttccgaattcggcacgaaacccgccgcgatggtgacccggttcctgggcccacgctaccgggagctggtcaagaactgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtgcctggtggtgctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctgc

SEQ ID NO: 73331 - DNA, 1059 bp, Homo sapiens
ccctccccgcgcgcgtgcgcgccgcggccgcgcctgcgcagtgtagccgggtcagctggacagggtcatcctgagggtgcgactccgccgcgatggtgacccggttcctgggcccacgctaccgggagctggtcaagaactgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtgcctggtggtgctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctgcaaaaaaaaaaaaaaaaaaaaaaaaaaaaaaaaaaaaaaaaaaaaaaaaaacaacaaaaaaaaaaaaaaaaaaaagaagggggaaaaaaaaaaaaaaaaaaaaaaaagaaaaaaaagagacggcgggcagcgatgtatatgataagaaaagaaggagcacacacaaaaaagaagggaaacacaaaataaacaagaacaagagaggaaggcagcgcgccccatcaaaacacacgaggcggagtcacgagagaagaaaaccgcgccacggcggcaggacacattagaggaaagaggcacccacaaacacacggcgagggggaacaacgacaacagaacgagggaaaagcccacacggcaccgagacaacataggtgcccgacgacacgaacgaatgacgagaaacagaacactcacaccgatgaagagtaggagcaagcaacaccaagcccacgacatagagaaggaagcggaggaagaggaaaatagcgatggaacacacacgaaagaacgagataagagaaagcgaccgaaaccacaggggcggaaggcagaacaacatgagacgcaacaacacaccgccaagcagcaggaagagcgaagt

SEQ ID NO: 73332 - DNA, 358 bp, Homo sapiens
  misc_feature (26)..(26): n is a, c, g, or t
gccgcagtgtgcctggattcccgggngctggtcaagaactgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtgcctggtggtgctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctgc

SEQ ID NO: 73333 - DNA, 1211 bp, Homo sapiens
ggtaaaaggggacctgctgcctggagggctcaggtctgagcacagggagccctcagcgcccacttcagcagacctattgggaatttactacctggagaccaattataggtctagggtcttctttgtgaatttgggggaatcgaggccttgaggggtgagaggtatggtctaaggtcacagtctgggagaggagtccttgggatcagaggttgtgcagaagcaccttccccacctcctgcctcatgagataaggttgccaggattcccattatcacggtgaacaccacgcgtccgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtgcctggtggtgctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctgcaaaaaaaaaaaaaaaaaaaaaaaaaaaaaaaaaaaaaaaaaaaaaaaaaacaacaaaaaaaaaaaaaaaaaaaagaagggggaaaaaaaaaaaaaaaaaaaaaaaagaaaaaaaagagacggcgggcagcgatgtatatgataagaaaagaaggagcacacacaaaaaagaagggaaacacaaaataaacaagaacaagagaggaaggcagcgcgccccatcaaaacacacgaggcggagtcacgagagaagaaaaccgcgccacggcggcaggacacattagaggaaagaggcacccacaaacacacggcgagggggaacaacgacaacagaacgagggaaaagcccacacggcaccgagacaacataggtgcccgacgacacgaacgaatgacgagaaacagaacactcacaccgatgaagagtaggagcaagcaacaccaagcccacgacatagagaaggaagcggaggaagaggaaaatagcgatggaacacacacgaaagaacgagataagagaaagcgaccgaaaccacaggggcggaaggcagaacaacatgagacgcaacaacacaccgccaagcagcaggaagagcgaagt

SEQ ID NO: 73334 - DNA, 669 bp, Homo sapiens
ggcagcacacgaagtctaaagagattattctcttcccacagataccttttgagcaagccacagtgcttctatgagccaccctgagaagtctcacgtgatcacttccgccacagcctgtttatcaaaagcaagccccccaggcccagcccacgtgcagagggaggagaatgaggttctgtgttttgaagggaagaatatcagaattggtagacatttcaaactgtcacattagggatacaaaaatgaacaggctgggagtggtggctcagcctacaatcccaacactttgggaggctgaggaaggggcatcacttgaaccaggagttcagtactaacctgggcaacaaagaggcccctgtctctgataaaaagaaaaaaaatgaaaaaataaaaatgaacaggtataaaaagagaatcatccctatttctttacatgtcttaacttattcctcattacaatccaacatcctttgccaaactatttatccatgtaattctttttgccatttttaaacccgtctttatcatattataccccatggaatattgtccttttattatcaagcatattttatacggccttttttattatcatgatgtattactatatctcttgcaatatcttttcaggatatacaatattttgcccacgtatctatattcctcctt

SEQ ID NO: 73335 - DNA, 1495 bp, Homo sapiens
cccatcccccctcccccccttcccccccccccccccctcccccccccccccccccctccccctccccctccccctctccccctcccccccccctcccctcccctcctccccccccccccctccccccccgccccccccccccccccccccccccccccccccccccccccccaactatcggcttggtcgaggcctggctttggccgggtcagctggacagggtcatcctgagggtgcgactccgccgcgatggtgacccggttcctgggcccacgctaccgggagctggtcaagaactgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtgcctggtggtgctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctgctccgtgcccggatgttgatcatgctggtggcttggttactgtgactgtagctggagtggcacaggtgacccaggcgtcctttcagctccagaatgttgcaagtctaggagagtgttccaatggctgacagaaactgcctatttgaaatggctcataagtagtatctgcagtgtgttcatccgttgctgccttaacaagtcacccacacgtagtggcttaaagcaacgaacattcactctctcacagtctgtgtcagtcggggatttgggagtgatgtatctgggtggttgtggcccagagtctctcatgaggttgcagttaagacatcagccaaggccacttcgtctgaggaaggctcaactggggctggagccacttccaagccagtgccctcacgtggctgtcggtgacagccacagttccttcccatgggggcccctacacgaagctgcttgagcatcctcacggcatggcctctgccttccccagagcaggtgaaccaagggagaggaaggagcaagccacagtgcttctatgagccaccctgagaagtctcacgtgatcacttccgccacagcctgtttatcaaaagcaagccccccaggcccagcccacgtgcagagggaggagaatgaggttctgtgttttgaagggaagaatatcagaattggtagacatttcaaactgtcacattagggatacaaaaatgaacaggctgggagtggtggctcagcctacaatcccaacactttgggaggctgaggaaggggcatcacttgaaccaggagttcagtactaacctgggcaacaaagaggcccctgtctctgataaaaagaaaaaaaatgaaaaaataaaaatgaacaggtataaaaagagaa

SEQ ID NO: 73336 - DNA, 610 bp, Homo sapiens
  misc_feature (460)..(460): n is a, c, g, or t
  misc_feature (462)..(462): n is a, c, g, or t
ccctccccgcgcgcgtgcgcgccgcggccgcgcctgcgcagtgtagccgggtcagctggacagggtcatcctgagggtgcgactccgccgcgatggtgacccggttcctgggcccacgctaccgggagctggtcaagaactgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtgcctggtggtgctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctgcncnaacaaaacattttattattatttatgttccaaaacaggttggggtgcacacgaggaactttcacacttgtaggaatttaatcccagggggggggcacctcattttctccaaatattactctttggactgggtcgtgaaaaaaaacacc

SEQ ID NO: 73337 - DNA, 396 bp, Homo sapiens
ctctggggaaggcagaggccatgccgtgaggatgctcaagcagcttcgtgtaggggccaccctgagaagtctcacgtgatcacttccgccacagcctgtttatcaaaagcaagccccccaggcccagcccacgtgcagagggaggagaatgaggttctgtgttttgaagggaagaatatcagaattggtagacatttcaaactgtcacattagggatacaaaaatgaacaggctgggagtggtggctcagcctacaatcccaacactttgggaggctgaggaaggggcatcacttgaaccaggagttcagtactaacctgggcaacaaagaggcccctgtctctgataaaaagaaaaaaaatgaaaaaataaaaatgaacaggtataaaaagagaa

SEQ ID NO: 73338 - DNA, 939 bp, Homo sapiens
cccatcccccctcccccccttcccccccccccccccctcccccccccccccccccctccccctccccctccccctctccccctcccccccccctcccctcccctcctccccccccccccctccccccccgccccccccccccccccccccccccccccccccccccccccccaactatcggcttggtcgaggcctggctttggccgggtcagctggacagggtcatcctgagggtgcgactccgccgcgatggtgacccggttcctgggcccacgctaccgggagctggtcaagaactgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtaagtttcagtgggctgcggtgggtggactgcatgatggccggatggtggccgaagagtgggttctccaggctcccagagccggggcggcagccctcactgctccccctggagagacctgcattcgagagtggggccctgggtgccccttctggcatctccggcccacgggcacagaactgtccgccccgcagccttgggttgtgtgattggggtgtgggcctcgccctccctctggacaatcccagtgagtctttgaggcaaaccttgcttccgtctcagtgggcactgcagcctgaactgggtggggcccatgttacagacagagggggaaggtggaggctggcccacagtggctggacaccccatgagctcttggaagcgcctgtgaggccctggacgcatccacgtgtttctccagcatgccagctgcccccttaaccacagtgcctgtggcatcttcccagtgcccacatgacagtcccacgtgg

SEQ ID NO: 73339 - DNA, 540 bp, Homo sapiens
  misc_feature (495)..(495): n is a, c, g, or t
cccatcccccctcccccccttcccccccccccccccctcccccccccccccccccctccccctccccctccccctctccccctcccccccccctcccctcccctcctccccccccccccctccccccccgccccccccccccccccccccccccccccccccccccccccccaactatcggcttggtcgaggcctggctttggccgggtcagctggacagggtcatcctgagggtgcgactccgccgcgatggtgacccggttcctgggcccacgctaccgggagctggtcaagaactgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtgctgtgtgctagctctcactacactctgcatctgagcagcccaanctagatgacagagaaccacactactagctctatgttctgaaacac

SEQ ID NO: 73340 - DNA, 616 bp, Homo sapiens
cccatcccccctcccccccttcccccccccccccccctcccccccccccccccccctccccctccccctccccctctccccctcccccccccctcccctcccctcctccccccccccccctccccccccgccccccccccccccccccccccccccccccccccccccccccaactatcggcttggtcgaggcctggctttggccgggtcagctggacagggtcatcctgagggtgcgactccgccgcgatggtgacccggttcctgggcccacgctaccgggagctggtcaagaactgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtgcctggtggtgctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctgc

SEQ ID NO: 73341 - DNA, 411 bp, Homo sapiens
ggctaggtacgaggcgggtgtgaatcggacgaggcgccgccgcgatggtgacccggttcctgggcccacgctaccgggagctggtcaagaactgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtgcctggtggtgctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctgc

SEQ ID NO: 73342 - DNA, 1007 bp, Homo sapiens
ggtggagctccgggtttatttggacgagggagccgccgcgatggtgacccggttcctgggcccacgctaccgggagctggtcaagaactgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtgcctggtggtgctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctgcaaaaaaaaaaaaaaaaaaaaaaaaaaaaaaaaaaaaaaaaaaaaaaaaaacaacaaaaaaaaaaaaaaaaaaaagaagggggaaaaaaaaaaaaaaaaaaaaaaaagaaaaaaaagagacggcgggcagcgatgtatatgataagaaaagaaggagcacacacaaaaaagaagggaaacacaaaataaacaagaacaagagaggaaggcagcgcgccccatcaaaacacacgaggcggagtcacgagagaagaaaaccgcgccacggcggcaggacacattagaggaaagaggcacccacaaacacacggcgagggggaacaacgacaacagaacgagggaaaagcccacacggcaccgagacaacataggtgcccgacgacacgaacgaatgacgagaaacagaacactcacaccgatgaagagtaggagcaagcaacaccaagcccacgacatagagaaggaagcggaggaagaggaaaatagcgatggaacacacacgaaagaacgagataagagaaagcgaccgaaaccacaggggcggaaggcagaacaacatgagacgcaacaacacaccgccaagcagcaggaagagcgaagt

SEQ ID NO: 73343 - DNA, 2095 bp, Homo sapiens
cccatcccccctcccccccttcccccccccccccccctcccccccccccccccccctccccctccccctccccctctccccctcccccccccctcccctcccctcctccccccccccccctccccccccgccccccccccccccccccccccccccccccccccccccccccaactatcggcttggtcgaggcctggctttggccgggtcagctggacagggtcatcctgagggtgcgactccgccgcgatggtgacccggttcctgggcccacgctaccgggagctggtcaagaactgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtgcctggtggtgctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctgctccgtgcccggatgttgatcatgctggtggcttggttactgtgactgtagctggagtggcacaggtgacccaggcgtcctttcagctccagaatgttgcaagtctaggagagtgttccaatggctgacagaaactgcctatttgaaatggctcataagtagtatctgcagtgtgttcatccgttgctgccttaacaagtcacccacacgtagtggcttaaagcaacgaacattcactctctcacagtctgtgtcagtcggggatttgggagtgatgtatctgggtggttgtggcccagagtctctcatgaggttgcagttaagacatcagccaaggccacttcgtctgaggaaggctcaactggggctggagccacttccaagccagtgccctcacgtggctgtcggtgacagccacagttccttcccatgggggcccctacacgaagctgcttgagcatcctcacggcatggcctctgccttccccagagcaggtgaaccaagggagaggaaggagcaagccacagtgcttctatgagccaccctgagaagtctcacgtgatcacttccgccacagcctgtttatcaaaagcaagccccccaggcccagcccacgtgcagagggaggagaatgaggttctgtgttttgaagggaagaatatcagaattggtagacatttcaaactgtcacattagggatacaaaaatgaacaggctgggagtggtggctcagcctacaatcccaacactttgggaggctgaggaaggggcatcacttgaaccaggagttcagtactaacctgggcaacaaagaggcccctgtctctgataaaaagaaaaaaaatgaaaaaataaaaatgaacaggtataaaaagagaaaaaaaaaaaaaaaaaaaaaaaaaaaaaaaaaaaaaaaaaaaaaaaaaaaacaacaaaaaaaaaaaaaaaaaaaagaagggggaaaaaaaaaaaaaaaaaaaaaaaagaaaaaaaagagacggcgggcagcgatgtatatgataagaaaagaaggagcacacacaaaaaagaagggaaacacaaaataaacaagaacaagagaggaaggcagcgcgccccatcaaaacacacgaggcggagtcacgagagaagaaaaccgcgccacggcggcaggacacattagaggaaagaggcacccacaaacacacggcgagggggaacaacgacaacagaacgagggaaaagcccacacggcaccgagacaacataggtgcccgacgacacgaacgaatgacgagaaacagaacactcacaccgatgaagagtaggagcaagcaacaccaagcccacgacatagagaaggaagcggaggaagaggaaaatagcgatggaacacacacgaaagaacgagataagagaaagcgaccgaaaccacaggggcggaaggcagaacaacatgagacgcaacaacacaccgccaagcagcaggaagagcgaagt

SEQ ID NO: 73344 - DNA, 1290 bp, Homo sapiens
ggctaggtacgaggcgggtgtgaatcggacgaggcgccgccgcgatggtgacccggttcctgggcccacgctaccgggagctggtcaagaactgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtgcctggtggtgctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctgctccgtgcccggatgttgatcatgctggtggcttggttactgtgactgtagctggagtggcacaggtgacccaggcgtcctttcagctccagaatgttgcaagtctaggagagtgttccaatggctgacagaaactgcctatttgaaatggctcataagtagtatctgcagtgtgttcatccgttgctgccttaacaagtcacccacacgtagtggcttaaagcaacgaacattcactctctcacagtctgtgtcagtcggggatttgggagtgatgtatctgggtggttgtggcccagagtctctcatgaggttgcagttaagacatcagccaaggccacttcgtctgaggaaggctcaactggggctggagccacttccaagccagtgccctcacgtggctgtcggtgacagccacagttccttcccatgggggcccctacacgaagctgcttgagcatcctcacggcatggcctctgccttccccagagcaggtgaaccaagggagaggaaggagcaagccacagtgcttctatgagccaccctgagaagtctcacgtgatcacttccgccacagcctgtttatcaaaagcaagccccccaggcccagcccacgtgcagagggaggagaatgaggttctgtgttttgaagggaagaatatcagaattggtagacatttcaaactgtcacattagggatacaaaaatgaacaggctgggagtggtggctcagcctacaatcccaacactttgggaggctgaggaaggggcatcacttgaaccaggagttcagtactaacctgggcaacaaagaggcccctgtctctgataaaaagaaaaaaaatgaaaaaataaaaatgaacaggtataaaaagagaa

SEQ ID NO: 73345 - DNA, 749 bp, Homo sapiens
cccatcccccctcccccccttcccccccccccccccctcccccccccccccccccctccccctccccctccccctctccccctcccccccccctcccctcccctcctccccccccccccctccccccccgccccccccccccccccccccccccccccccccccccccccccaactatcggcttggtcgaggcctggctttggccgggtcagctggacagggtcatcctgagggtgcgactccgccgcgatggtgacccggttcctgggcccacgctaccgggagctggtcaagaactgaatgccatcaagacaacacgtgcgaagattcctgccctgttggtggcatctgcctccgagccaggttccaggagcagctgtgcgtgcccccagctggtgagcgggcacctggcctacacttggagagtctctgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtgcctggtggtgctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctgc

SEQ ID NO: 73346 - DNA, 592 bp, Homo sapiens
cataggctccagaaaacaagaagcaagactggaaagctggggatgattgtacgccctcgcctgaatcttacgtggttcctccttcttccacctggccagtgcagagccgtgggtgccacgtggccacttctggattgggttccccttggcctgccaccctgtccttctgctttcccactttgccagccagagtcaatttgaggacgccaagttctcctctccatacagagctcctggtctccttgtaacttgtaactcctgggcacagttacaagtgctgaattcttgcgaggatgaactcaagatacaaaatatgcttggcaactcacccctgagtggccacaggcacacgcaggagtcgaacccacccacctctgctgacagtcatgggtcaagctcaaagtcctggctgcttctctgctcaagaaattgccacagcctccgtaaccttcagcagccaccatcctgatcagttagcagccatcatcaagacaagacccttccccagcataaacattacggcttgctgaagacttagatcatagttagcatttttaagcaatcaagtgttttaaaattaaggtatgtacat

SEQ ID NO: 73347 - DNA, 519 bp, Homo sapiens
aaaaagttaattgaagaaaagtagaaatcaaatatttcagttgttctgaatcatgagtaagatgcctataaggaagaaaaattctcctaaatgactacatctggtcatgccttcttagcttttaaagtattttgtgatacacaggaatttatgtttttttcctgaggtgaagctctctgtaagaaggaaagcagatgtttctttttaagtgcttgtatacacctgccacaaggcagactgagtagttcatatggagagcaggctcgggttattttttatgttgcttgtgaaattaaaattcttttcctggcaagcataggtttataattaagtaatttatcataagagttcttttagctatatcaaaaatttgatgatatacagaagcaatatgtgagtggttacttagaaattagatgaatgagttatttcattggcatttatcatttgatgtgtaggtttttcctatttataacaaacattgaacactgactaattacctgcaactgaaagagggtt

SEQ ID NO: 73348 - DNA, 518 bp, Homo sapiens
gccttagtattctcgaggctgtttcttacagcaacccttgctggaaggtgagggcatgacaaaaaaacatgactcagtgatagcagttttcttagcgggatggggttgtgttgggagactagttgggttgggtagtgaagccaaagcattttgtttctgacagtccagtttaacgccagaataaaatacagagtaggtaagtgggtagaatgcgtgactctcaaacaattctttgtcgagttagtcttcatcagtcattgttttatcattgctaggtggaccacattgtacagttaagctctctggcacaggtctaagtgctgtgctttgtgctgctggttatggtaaccccatcactttaccaaataatgcagggttgaccctttgtgtgggttttatggagcttcattaaccacaattctcacctggataaatgcctccaaggtagaccaagggaatgccagacaagaccaggatattgctttgaaaagactcctggttgcagtgtggagtttaaa

SEQ ID NO: 73349 - DNA, 294 bp, Homo sapiens
cagttgtaaaaattgccctagtttgttaagtttcctactgttaggaagtggtagtttttattttattacccttgcagttttattagaaagttatattcttttaatggaaataacccttttaaagaataaatgtgttatctcctatttgttttcatttagtatatattctttaccttaatcttatattatttaagtatgagctcttcagaaaggaaattaggatgaagaggatttcatgtatttttcaatatcctggattcagtaaacagcaattttaacttctaggccatataa

SEQ ID NO: 73350 - DNA, 1271 bp, Homo sapiens
cccgagtagctgggattgcaggcatgcaccatcacacctggctaattttgtattttcagtagagacagcgttttgccatgctggccaggctcgtctcgaactcctgacctcaggtgatccgcccaccttggcctcccaaagtgctgggattacacgcgtgagccaccatgcccggccaatactacactcttattctgccttacgaggatttctggaagcttctgtaactgtagggaagaaagctgtaggggagcatggtttttttgttttgtttttgtttttgagacgaggtctcactgtcacccaggctggagtgcagtggtgccatcatgactcactgcagccttgacctcccaggcgcacaaaatcctcctctcagcctgagtaactgggactacaggtgtgtaccactacatccagctaaaggagagcgtttttttctttttctttttgagacagagtctcactctggcgcctggtcactgtgcccttcaccttctgggttcaagtgattctcctgcctcagcctccctagtagctgggattacaggcatgcaccaccatacccagctaatttctggtatttttagtagagatggagtttcaccatgttggccaggctggtctcgaactcctgacctcaggtgatccacctgcctcggcctcccaaagtgctaggattacaggcgtgagccaccatgcccagctgggagcgttctttcagcaaaaagtctaattcagagactcaccttccatcctggcactaaacaatagtactagaggtaagatctgccaagaatttctctcacttaagcaggatacttactttaaatataattaggcaagacttatttgagtacttgcctaattgtatttaattagaactatgctggatgctgtagacagaagaaataaaatactcaacttggtccctatcttccagcaggttagaggcctttagggaagaaaagcctgtgtgcagggaaagagaacctcaccagaaagtattcaataaaatgccaaagtgatcttacagaacagtgcctgtgacaccggaggggattgttctgtctttgtgagtgaacatacaatgatggggataactggtcctcataccatgcaggtcccatttctgatcaccccactggcaggacaattcacagttcttgagcaaactgagttagggagggtatgctaacgacagaacctatgcaagttcttagaaatattttttgtttgctgaaataaagctcaatcaacacactacctta

SEQ ID NO: 73351 - DNA, 1472 bp, Homo sapiens
cccgagtagctgggattgcaggcatgcaccatcacacctggctaattttgtattttcagtagagacagcgttttgccatgctggccaggctcgtctcgaactcctgacctcaggtgatccgcccaccttggcctcccaaagtgctgggattacacgcgtgagccaccatgcccggccaatactacactcttattctgccttacgaggatttctggaagcttctgtaactgtagggaagaaagctgtaggggagcatggtttttttgttttgtttttgtttttgagacgaggtctcactgtcacccaggctggagtgcagtggtgccatcatgactcactgcagccttgacctcccaggcgcacaaaatcctcctctcagcctgagtaactgggactacaggtgtgtaccactacatccagctaaaggagagcgtttttttctttttctttttgagacagagtctcactctggcgcctggtcactgtgcccttcaccttctgggttcaagtgattctcctgcctcagcctccctagtagctgggattacaggcatgcaccaccatacccagctaatttctggtatttttagtagagatggagtttcaccatgttggccaggctggtctcgaactcctgacctcaggtgatccacctgcctcggcctcccaaagtgctaggattacaggcgtgagccaccatgcccagctgggagcgttctttcagcaaaaagtctaattcagagactcaccttccatcctggcactaaacaatagtactagaggtaagatctgccaagaatttctctcacttaagcaggatacttactttaaatataattaggcaagacttatttgagtacttgcctaattgtatttaattagaactatgctggatgctgtagacagaagaaataaaatactcaacttggtccctatcttccagcaggttagaggcctttagggaagaaaagcctgtgtgcagggaaagagaacctcaccagaaagtattcaataaaatgccaaagtgatcttacagaacagtgcctgtgacaccggaggggattgttctgtctttgtgagtgaacatacaatgatggggataactggtcctcataccatgcaggtcccatttctgatcaccccactggcaggacaattcacagttcttgagcaaactgagttagggagggtatgctaacgacagaacctatgcaagttcttagaaatattttttgtttgctgaaataaagctcaatcaacacactaccttaaaaaaaagtggagcagtggcatttccatgcctcatgctcaccatcatgaggttaacttcccgccgtcgcctcttgcctgccaggggtttttcgggagcccctctctgttccactctgattccttttgtttctttgctgaccattcactctctgtgtctgttgttggatccaaatacgagtgtttttctttcaaattgtggt
